(12) United States Patent
Kahsay et al.

(10) Patent No.: US 8,623,623 B2
(45) Date of Patent: Jan. 7, 2014

(54) XYLOSE UTILIZATION IN RECOMBINANT ZYMOMONAS

(75) Inventors: Robel Y. Kahsay, Wilmington, DE (US); Min Qi, Hockessin, DE (US); Luan Tao, Wallingford, PA (US); Paul V. Viitanen, West Chester, PA (US); Jianjun Yang, Hockessin, DE (US)

(73) Assignee: E I du Pont de Nemours and Company, Wilmington, DE (US)

( * ) Notice: Subject to any disclaimer, the term of this patent is extended or adjusted under 35 U.S.C. 154(b) by 29 days.

(21) Appl. No.: 13/161,749

(22) Filed: Jun. 16, 2011

(65) Prior Publication Data

US 2011/0318801 A1 Dec. 29, 2011

Related U.S. Application Data

(60) Provisional application No. 61/359,463, filed on Jun. 29, 2010.

(51) Int. Cl.
*C12N 9/00* (2006.01)
(52) U.S. Cl.
USPC ........................................................ 435/183
(58) Field of Classification Search
USPC ........................................................ 435/183
See application file for complete search history.

(56) References Cited

U.S. PATENT DOCUMENTS

| | | | |
|---|---|---|---|
| 5,514,583 A | 5/1996 | Picataggio et al. |
| 5,712,133 A | 1/1998 | Picataggio et al. |
| 5,843,760 A | 12/1998 | Zhang et al. |
| 6,475,768 B1 | 11/2002 | Otero et al. |
| 6,566,107 B1 | 5/2003 | Zhang |
| 7,223,575 B2 | 5/2007 | Zhang et al. |
| 7,629,156 B2 | 12/2009 | Viitanen et al. |
| 7,741,084 B2 | 6/2010 | Viitanen et al. |
| 7,741,119 B2 | 6/2010 | Viitanen et al. |
| 7,803,623 B2 | 9/2010 | Caimi et al. |
| 7,989,206 B2 | 8/2011 | Viitanen et al. |
| 7,998,722 B2 | 8/2011 | Viitanen et al. |
| 2011/0014670 A1 | 1/2011 | Caimi et al. |
| 2011/0143408 A1 | 6/2011 | Yang |

FOREIGN PATENT DOCUMENTS

WO 2009120731 A2 10/2009

OTHER PUBLICATIONS

Feldmann, Sigrun D. et al., Pentose metabolism in *Zymomonas mobilis* wild-type and recombinant strains, Applied Microbiology and Biotechnology, 1992, pp. 354-361, vol. 38, Springer-Verlag.
Yanase, Hideshi et al., Genetic Engineering of *Zymobacter palmae* for Production of Ethanol from Xylose, Applied and Environmental Microbiology, Apr. 2007, pp. 2592-2599, vol. 73, No. 8, American Society for Microbiology.
Zhang, Min et al., Metabolic Engineering of a Pentose Metabolism Pathway in Ethanologenic *Zymomonas mobilis*, Science, Jan. 13, 1995, pp. 240-243, vol. 267.
Caimi, Perry G. et al., U.S. Appl. No. 13/161734, filed Jun. 16, 2011.
Park, Joo-Heon et al., Restoration of a Defective *Lactococcus lactis* Xylose Isomerase, Applied and Environmental Microbiology, Jul. 2004, pp. 4318-4325, vol. 70, No. 7, American Society for Microbiology.
GenBank Accession No. P19148.
GenBank Accession No. 443568.
Van Bastelaere, Petra et al., Kinetic studies of $Mg^{2+}$-, $Co^{2+}$ and $Mn^{2+}$-activated D-xylose isomerases, Biochemical Journal, 1991, pp. 285-292, vol. 278.
Liu, Chun-Qiang et al., Expression of cloned *Xanthomonas* D-xylose catabolic genes in *Zymomonas mobilis*, Journal of Biotechnology, 1988, pp. 61-70, vol. 7.
International Search Report dated Oct. 19, 2011, International Application No. PCT/US2011/042132.

*Primary Examiner* — Karen Cochrane Carlson

(57) ABSTRACT

*Zymomonas* expressing xylose isomerase from *A. missouriensis* was found to have improved xylose utilization, growth, and ethanol production when grown in media containing xylose. Xylose isomerases related to that of *A. missouriensis* were identified structurally through molecular phylogenetic and Profile Hidden Markov Model analyses, providing xylose isomerases that may be used to improve xylose utilization.

12 Claims, 7 Drawing Sheets

- Group I
- Group II
- A. missouriensis
- L. brevis
- E. coli

XYLOSE UTILIZATION IN RECOMBINANT ZYMOMONAS

This application claims the benefit of U.S. Provisional Application 61/359,463, filed Jun. 29, 2010 and is incorporated by reference in its entirety.

STATEMENT OF GOVERNMENT RIGHTS

This invention was made with United States government support under Contract Nos. DE-FC36-07GO17056 awarded by the Department of Energy. The government has certain rights in this invention.

FIELD OF THE INVENTION

The invention relates to the fields of microbiology and genetic engineering. More specifically, xylose isomerases with high activity in *Zymomonas* were identified that provide for improved xylose utilization and ethanol production.

BACKGROUND OF THE INVENTION

Production of ethanol by microorganisms provides an alternative energy source to fossil fuels and is therefore an important area of current research. It is desirable that microorganisms producing ethanol, as well as other useful products, be capable of using xylose as a carbon source since xylose is the major pentose in hydrolyzed lignocellulosic biomass. Biomass can provide an abundantly available, low cost carbon substrate. *Zymomonas mobilis* and other bacterial ethanologens which do not naturally utilize xylose have been genetically engineered for xylose utilization by introduction of genes encoding 1) xylose isomerase, which catalyses the conversion of xylose to xylulose; 2) xylulokinase, which phosphorylates xylulose to form xylulose 5-phosphate; 3) transketolase; and 4) transaldolase. Typically the coding regions used were from *E. coli* genes.

There has been success in engineering *Z. mobilis* strains for xylose metabolism (U.S. Pat. No. 5,514,583, U.S. Pat. No. 5,712,133, U.S. Pat. No. 6,566,107, WO 95/28476, Feldmann et al. (1992) Appl. Microbiol. Biotechnol. 38: 354-361, Zhang et al. (1995) Science 267:240-243), as well as a *Zymobacter palmae* strain (Yanase et al. (2007) Appl. Environ. Mirobiol. 73:2592-2599). However, typically the engineered strains do not grow and produce ethanol as well on xylose as on glucose. Strains engineered for xylose utilization have been adapted by serial passage on xylose medium, resulting in strains with improved xylose utilization as described in U.S. Pat. No. 7,223,575 and U.S. Pat. No. 7,741,119. Disclosed in commonly owned and co-pending US Patent Application Publication US 20090246846A1 is engineering for improved xylose utilization by expression of *E. coli* xylose isomerase from a mutated, highly active *Zymomonas mobilis* glyceraldehyde-3-phosphate dehydrogenase gene promoter (Pgap).

There remains a need for strains of *Zymomonas*, and other bacterial ethanolagens, which have further improvement in xylose utilization.

SUMMARY OF THE INVENTION

The invention provides recombinant xylose-utilizing *Zymomonas* or *Zymobacter* cells that express a highly active xylose isomerase providing improved xylose utilization and ethanol production.

Accordingly, the invention provides a recombinant bacterial strain selected from the group consisting of *Zymomonas* and *Zymobacter* comprising a heterologous nucleic acid molecule encoding a polypeptide having xylose isomerase activity wherein the polypeptide is a Group I xylose isomerase and is included in the class of enzymes identified by EC 5.3.1.5, and wherein the strain utilizes xylose as a carbon source.

Xylose isomerase enzymes useful in the invention are those that have an E-value score of 1E-15 or less when queried using a Profile Hidden Markov Model prepared using SEQ ID NOs: 2, 24, 32, 34, 42, 54, 66, 68, 78, 96, 100, 106, 108, 122, 126, 128, 130, 132, 135, 137, and 142; the query being carried out using the hmmsearch algorithm wherein the Z parameter is set to 1 billion, or those that have at least 90% identity to an amino acid sequence selected from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 131, 132, 133, 134, 135, 136, 137, 138, 139, 140, 141, 142, 143, 144, 145, 146, and 147 based on the Clustal W method of alignment using the default parameters of GAP PENALTY=10, GAP LENGTH PENALTY=0.1, and Gonnet 250 series of protein weight matrix; or those that have the following conserved amino acids, or 90% of the following conserved amino acids, when compared with the reference amino acid sequence of SEQ ID NO:66:
 a) leucine at position 226,
 b) methionine at position 223,
 c) isoleucine at position 191,
 d) threonine, serine, or valine at position 195,
 e) methionine, threonine or guanine at position 88,
 f) histidine at position 290,
 g) glutamic acid or aspartic acid at position 221,
 h) phenylalanine, valine, or leucine at position 242,
 i) histidine at position 243,
 j) leucine, phenylalanine, or methionine at position 193,
 k) glutamine at position 256,
 l) glycine at position 213,
 m) proline, tyrosine, alanine, or serine at position 288, and
 n) glutamine at position 249.

In another embodiment the invention provides a process for improving xylose utilization in a recombinant bacterial cell comprising:
 a) providing a recombinant bacterial strain selected from the group consisting of *Zymomonas* and *Zymobacter* comprising a xylose utilization pathway comprising a xylose isomerase not belonging to Group I; and
 b) introducing a heterologous nucleic acid molecule encoding a polypeptide having xylose isomerase activity wherein the polypeptide is a Group I xylose isomerase.

Alternatively the invention provides a method for the production of ethanol comprising:
 a) providing the recombinant bacterial strain of the invention; and
 b) contacting the strain of (a) with xylose under conditions whereby the strain produces ethanol.

BRIEF DESCRIPTION OF THE FIGURES AND SEQUENCE DESCRIPTIONS

Figure 7:
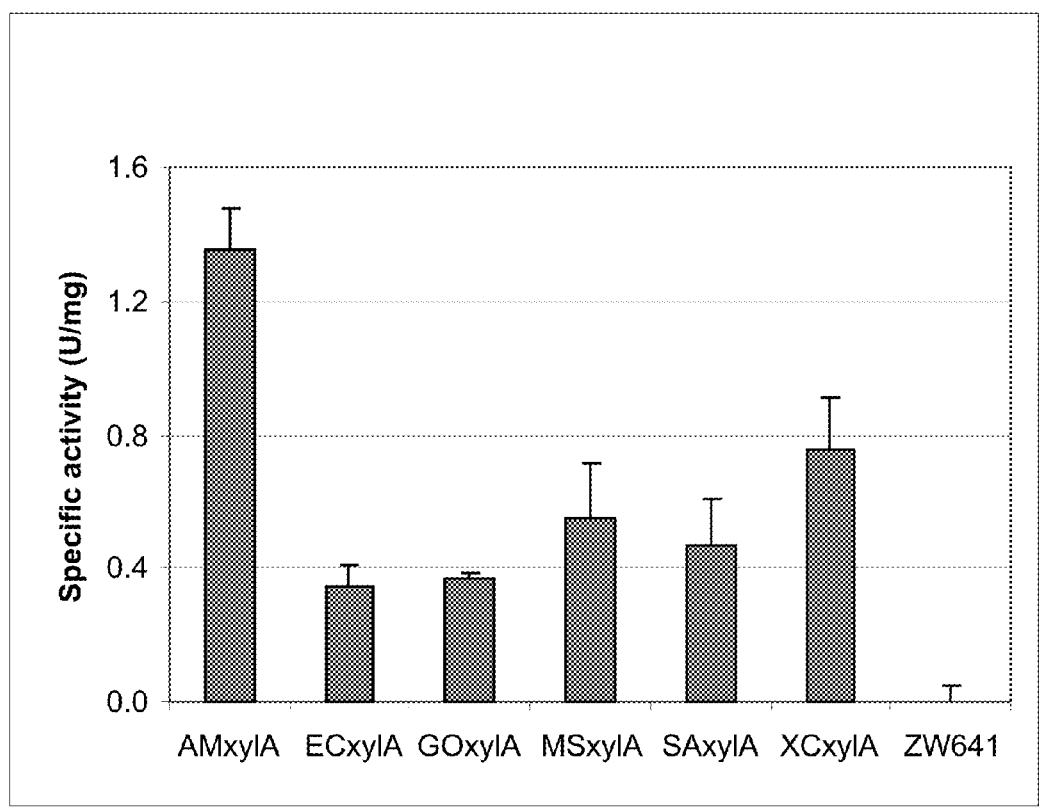

FIG. 7 is a graph of xylose isomerase activities in a control ZW641 strain and strains of ZW641 transformed with a gene having a codon-optimized coding region for expression of xylose isomerase from *A. missourinesis* (AMxylA), *E. coli* (ECxylA), Geodermatophilus obscurus (GOxylA), *Mycobacterium smegmatis* (MSxylA), Salinispora arenicola (SAxylA), or *Xylanimonas cellulosilytica* (XCxylA) measured by the Cysteine-Carboazole method.

Table 1 is a table of the Profile HMM for xylose isomerase Group I proteins. Table 1 is submitted herewith electronically and is incorporated herein by reference.

Table 2 is a table of the E-value scores for XI proteins, each identified by a SEQ ID NO, that were queried using the Group I profile HMM. Table 2 is submitted herewith electronically and is incorporated herein by reference The invention can be more fully understood from the following detailed description and the accompanying sequence descriptions which form a part of this application.

The following sequences conform with 37 C.F.R. 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5 (a-bis), and Section 208 and Annex C of the Administrative Instructions). The symbols and format used for nucleotide and amino acid sequence data comply with the rules set forth in 37 C.F.R. §1.822.

TABLE 3

SEQ ID numbers of Coding Regions and Proteins for Group I xylose isomerases. Uniprot accession number (AC) given for proteins that are seeds and NCBI GI number for given those that are not seeds.

| Organism | GI or AC # | SEQ ID NO: Nucleic acid | SEQ ID NO: Amino acid |
|---|---|---|---|
| Clavibacter michiganensis | B0RIF1 | 1 | 2 |
| Arthrobacter chlorophenolicus | 220912923 | 3 | 4 |
| Actinosynnema mirum | 226865307 | 5 | 6 |
| Kribbella flavida | 227382478 | 7 | 8 |
| Mycobacterium smegmatis | 118469437 | 9 | 10 |
| Arthrobacter sp. | 60615686 | 11 | 12 |
| Actinomyces urogenitalis | 227497116 | 13 | 14 |
| Streptomyces ambofaciens | 126348424 | 15 | 16 |
| Salinispora arenicola | 159039501 | 17 | 18 |
| Streptomyces sp. | 38141596 | 19 | 20 |

TABLE 3-continued

SEQ ID numbers of Coding Regions and Proteins for Group I xylose isomerases. Uniprot accession number (AC) given for proteins that are seeds and NCBI GI number for given those that are not seeds.

| Organism | GI or AC # | SEQ ID NO: Nucleic acid | SEQ ID NO: Amino acid |
|---|---|---|---|
| Meiothermus silvanus | 227989553 | 21 | 22 |
| Actinoplanes sp. | P10654 | 23 | 24 |
| Mobiluncus curtisii | 227493823 | 25 | 26 |
| Herpetosiphon aurantiacus | 159898286 | 27 | 28 |
| Acidothermus cellulolyticus | 117929271 | 29 | 30 |
| Streptomyces coelicolor | Q9L0B8 | 31 | 32 |
| Streptomyces avermitilis | Q93HF3 | 33 | 34 |
| Nocardiopsis dassonvillei | 229207664 | 35 | 36 |
| Nakamurella multipartita | 229221673 | 37 | 38 |
| Xylanimonas cellulosilytica | 227427650 | 39 | 40 |
| Clavibacter michiganensis | A5CPC1 | 41 | 42 |
| Salinispora tropica | 145596104 | 43 | 44 |
| Streptomyces sp. | 197764953 | 45 | 46 |
| Streptomyces pristinaespiralis | 197776540 | 47 | 48 |
| Roseiflexus sp. | 148656997 | 49 | 50 |
| Meiothermus ruber | 227992647 | 51 | 52 |
| Arthrobacter sp. | P12070 | 53 | 54 |
| Thermobaculum terrenum | 227374836 | 55 | 56 |
| Janibacter sp. | 84495191 | 57 | 58 |
| Brachybacterium faecium | 237671435 | 59 | 60 |
| Beutenbergia cavernae | 229821786 | 61 | 62 |
| Geodermatophilus obscurus | 227404617 | 63 | 64 |
| Actinoplanes missouriensis | P12851 | 65 | 66 |
| Streptomyces violaceusniger | P09033 | 67 | 68 |
| Actinomyces odontolyticus | 154508186 | 69 | 70 |
| Mobiluncus mulieris | 227875705 | 71 | 72 |
| Cellulomonas flavigena | 229243977 | 73 | 74 |
| Saccharomonospora viridis | 229886404 | 75 | 76 |
| Streptomyces lividans | Q9RFM4 | 77 | 78 |
| Frankia sp. | 158316430 | 79 | 80 |
| Streptosporangium roseum | 229851079 | 81 | 82 |
| Nocardioides sp. | 119716602 | 83 | 84 |
| Kribbella flavida | 227381155 | 85 | 86 |
| Roseiflexus castenholzii | 156742580 | 87 | 88 |
| Arthrobacter aurescens | 119964059 | 89 | 90 |
| Leifsonia xyli | 50954171 | 91 | 92 |
| Jonesia denitrificans | 227383768 | 93 | 94 |
| Streptomyces olivaceoviridis | Q93RJ9 | 95 | 96 |
| Stackebrandtia nassauensis | 229862570 | 97 | 98 |
| Thermus thermophilus | P26997 | 99 | 100 |
| Acidobacteria bacterium | 94967932 | 101 | 102 |
| Catenulispora acidiphila | 229246901 | 103 | 104 |
| Streptomyces corchorusii | Q9S3Z4 | 105 | 106 |
| Streptomyces thermocyaneoviolaceus | Q9L558 | 107 | 108 |
| marine actinobacterium | 88856315 | 109 | 110 |
| Micromonospora sp. | 237882534 | 111 | 112 |
| Thermobifida fusca | 72162004 | 113 | 114 |
| Herpetosiphon aurantiacus | 159897776 | 115 | 116 |
| Streptomyces griseus | 182434863 | 117 | 118 |
| Mycobacterium vanbaalenii | 120406242 | 119 | 120 |
| Streptomyces diastaticus | P50910 | 121 | 122 |
| Deinococcus geothermalis | 94972159 | 123 | 124 |
| Arthrobacter sp. | A0JXN9 | 125 | 126 |
| Streptomyces rubiginosus | P24300 | 127 | 128 |
| Streptomyces murinus | P37031 | 129 | 130 |
| Thermus caldophilus | 4930285 | * | 131 |
| Thermus caldophilus | P56681 | * | 132 |
| Arthrobacter sp. | 231103 | * | 133 |
| Actinoplanes missouriensis | 443486 | * | 134 |
| Streptomyces olivochromogenes | P15587 | * | 135 |
| Streptomyces olivochromogenes | 157879319 | * | 136 |
| Streptomyces rochei | P22857 | * | 137 |
| Streptomyces olivochromogenes | 157881044 | * | 138 |
| Streptomyces diastaticus | 7766813 | * | 139 |
| Actinoplanes missouriensis | 349936 | * | 140 |
| Arthrobacter sp. | 2914276 | * | 141 |
| Streptomyces albus | P24299 | * | 142 |
| Actinoplanes missouriensis | 443303 | * | 143 |

TABLE 3-continued

SEQ ID numbers of Coding Regions and Proteins for Group I xylose isomerases. Uniprot accession number (AC) given for proteins that are seeds and NCBI GI number for given those that are not seeds.

| Organism | GI or AC # | SEQ ID NO: Nucleic acid | SEQ ID NO: Amino acid |
|---|---|---|---|
| Streptomyces diastaticus | 9256915 | * | 144 |
| Actinoplanes missouriensis | 443526 | * | 145 |
| Streptomyces rubiginosus | 21730246 | * | 146 |
| Actinoplanes missouriensis | 443568 | * | 147 |

\* Sequence not readily available

TABLE 4

SEQ ID numbers of Proteins for Group II seed xylose isomerases. Uniprot accession number (AC) given for the seed proteins.

| Organism | AC # | SEQ ID NO: Amino acid |
|---|---|---|
| Salmonella enterica | B4T952 | 148 |
| Klebsiella pneumoniae | P29442 | 149 |
| Sinorhizobium meliloti | Q92LW9 | 150 |
| Escherichia coli | Q7A9X4 | 151 |
| Salmonella enterica | Q5PLM6 | 152 |
| Xanthomonas campestris | Q3BMF2 | 153 |
| Pectobacterium atrosepticum | Q6DB05 | 154 |
| Rhodopirellula baltica | Q7UVG2 | 155 |
| Xanthomonas axonopodis | Q8PEW5 | 156 |
| Xanthomonas oryzae | Q5GUF2 | 157 |
| Pediococcus pentosaceus | Q03HN1 | 158 |
| Brucella suis | Q8G204 | 159 |
| Escherichia coli | Q0TBN7 | 160 |
| Bifidobacterium longum | Q8G3Q1 | 161 |
| Brucella canis | A9M9H3 | 162 |
| Burkholderia multivorans | A9ARG7 | 163 |
| Brucella ovis | A5VPA1 | 164 |
| Rhizobium etli | B3Q0R5 | 165 |
| Burkholderia xenovorans | Q13RB8 | 166 |
| Actinobacillus pleuropneumoniae | A3N3K2 | 167 |
| Burkholderia cenocepacia | B4ENA5 | 168 |
| Solibacter usitatus | Q022S9 | 169 |
| Brucella abortus | B2SA37 | 170 |
| Rhodobacter sphaeroides | A4WVT8 | 171 |
| Thermoanaerobacter sp. | B0K1L3 | 172 |
| Yersinia pseudotuberculosis | Q1C0D3 | 173 |
| Xanthomonas oryzae | Q5GYQ7 | 174 |
| Bifidobacterium longum | B3DR33 | 175 |
| Thermoanaerobacter pseudethanolicus | P22842 | 176 |
| Photobacterium profundum | Q6LUY7 | 177 |
| Escherichia coli | B1LJC7 | 178 |
| Agrobacterium tumefaciens | Q8U7G6 | 179 |
| Tetragenococcus halophilus | O82845 | 180 |
| Salmonella enterica | B4TZ55 | 181 |
| Yersinia pseudotuberculosis | Q8Z9Z1 | 182 |
| Yersinia pseudotuberculosis | Q1CDB8 | 183 |
| Rhodobacter sphaeroides | A3PNM4 | 184 |
| Brucella abortus | Q2YMQ2 | 185 |
| Salmonella enterica | Q8ZL90 | 186 |
| Bacteroides vulgatus | A6L792 | 187 |
| Xanthomonas axonopodis | Q8PLL9 | 188 |
| Salmonella enterica | Q57IG0 | 189 |
| Escherichia coli | B7M3I8 | 190 |
| Roseobacter denitrificans | Q162B6 | 191 |
| Bacteroides fragilis | Q64U20 | 192 |
| Enterobacter sakazakii | A7MNI5 | 193 |
| Brucella abortus | Q57EI4 | 194 |
| Geobacillus thermodenitrificans | A4IP67 | 195 |
| Bacteroides thetaiotaomicron | Q8A9M2 | 196 |
| Haemophilus influenzae | A5UCZ3 | 197 |
| Yersinia pseudotuberculosis | B2K7D2 | 198 |
| Xanthomonas campestris | Q4UTU6 | 199 |
| Haemophilus somnus | B0UT19 | 200 |
| Pseudoalteromonas atlantica | Q15PG0 | 201 |

TABLE 4-continued

SEQ ID numbers of Proteins for Group II seed xylose isomerases. Uniprot accession number (AC) given for the seed proteins.

| Organism | AC # | SEQ ID NO: Amino acid |
|---|---|---|
| Escherichia fergusonii | B7LTH9 | 202 |
| Silicibacter sp. | Q1GKQ4 | 203 |
| Salmonella enterica | B5R4P8 | 204 |
| Bifidobacterium adolescentis | A1A0H0 | 205 |
| Staphylococcus xylosus | P27157 | 206 |
| Thermotoga maritima | Q9X1Z5 | 207 |
| Salmonella enterica | A9MUV0 | 208 |
| Pseudomonas syringae | Q48J73 | 209 |
| Shigella boydii | Q31V53 | 210 |
| Burkholderia ambifaria | Q0B1U7 | 211 |
| Bacillus amyloliquefaciens | A7Z522 | 212 |
| Haemophilus influenzae | A5UIN7 | 213 |
| Bacillus megaterium | O08325 | 214 |
| Arabidopsis thaliana | Q9FKK7 | 215 |
| Escherichia coli | Q3YVV0 | 216 |
| Bacteroides fragilis | Q5LCV9 | 217 |
| Pseudomonas fluorescens | Q3KDW0 | 218 |
| Escherichia coli | B1X8I1 | 219 |
| Bacillus subtilis | P04788 | 220 |
| Xanthomonas campestris | Q4UNZ4 | 221 |
| Pseudomonas syringae | Q4ZSF5 | 222 |
| Sinorhizobium medicae | A6UD89 | 223 |
| Ochrobactrum anthropi | A6X4G3 | 224 |
| Burkholderia thailandensis | Q2SW40 | 225 |
| Salmonella enterica | B5EX72 | 226 |
| Thermotoga sp. | B1LB08 | 227 |
| Bacillus cereus | Q739D2 | 228 |
| Salmonella enterica | B4SWK9 | 229 |
| Salmonella enterica | Q7C637 | 230 |
| Enterococcus faecalis | Q7C3R3 | 231 |
| Thermotoga neapolitana | P45687 | 232 |
| Escherichia coli | B7MES1 | 233 |
| Photorhabdus luminescens | Q7N4P7 | 234 |
| Enterobacter sp. | A4W566 | 235 |
| Burkholderia cenocepacia | B1KB47 | 236 |
| Bacillus licheniformis | P77832 | 237 |
| Geobacillus stearothermophilus | P54273 | 238 |
| Brucella abortus | Q8YFX5 | 239 |
| Rhizobium leguminosarum | Q1MBL8 | 240 |
| Yersinia enterocolitica | A1JT10 | 241 |
| Serratia proteamaculans | A8G7W8 | 242 |
| Yersinia pseudotuberculosis | A7FP68 | 243 |
| Escherichia coli | B7NEL7 | 244 |
| Yersinia pestis | A9R5Q1 | 245 |
| Fervidobacterium gondwanense | Q6T6K9 | 246 |
| Xanthomonas campestris | Q8P3H1 | 247 |
| Rhizobium leguminosarum | B5ZQV6 | 248 |
| Bradyrhizobium japonicum | Q89VC7 | 249 |
| Mesorhizobium sp. | Q11EH9 | 250 |
| Actinobacillus pleuropneumoniae | B3H2X9 | 251 |
| Yersinia pseudotuberculosis | Q663Y3 | 252 |
| Xanthomonas campestris | Q8P9T9 | 253 |
| Burkholderia cenocepacia | A0KE56 | 254 |
| Oceanobacillus iheyensis | Q8ELU7 | 255 |
| Brucella suis | B0CKM9 | 256 |
| Thermoanaerobacterium thermosaccharolyticum | P29441 | 257 |
| Burkholderia phymatum | B2JFE9 | 258 |
| Yersinia pseudotuberculosis | B1JH40 | 259 |
| Bacillus sp. | P54272 | 260 |
| Lactococcus lactis | Q02Y75 | 261 |
| Novosphingobium aromaticivorans | Q2GAB9 | 262 |
| Lactobacillus brevis | P29443 | 263 |
| Mesorhizobium loti | Q98CR8 | 264 |
| Escherichia coli | A8A623 | 265 |
| Burkholderia cenocepacia | Q1BG90 | 266 |
| Thermoanaerobacterium thermosulfurigenes | P19148 | 267 |
| Thermotoga petrophila | A5ILR5 | 268 |
| Lactobacillus pentosus | P21938 | 269 |
| Lactococcus lactis | Q9CFG7 | 270 |
| Ruminococcus flavefaciens | Q9S306 | 271 |
| Burkholderia phytofirmans | B2T929 | 272 |
| Salmonella enterica | B5FLD6 | 273 |
| Lactobacillus brevis | Q03TX3 | 274 |

TABLE 4-continued

SEQ ID numbers of Proteins for Group II seed xylose isomerases.
Uniprot accession number (AC) given for the seed proteins.

| Organism | AC # | SEQ ID NO: Amino acid |
|---|---|---|
| *Burkholderia ambifaria* | B1Z405 | 275 |
| *Salmonella enterica* | B5RGL6 | 276 |
| *Bacillus halodurans* | Q9K993 | 277 |
| *Bacillus clausii* | Q5WKJ3 | 278 |
| *Marinomonas* sp. | A6VWH1 | 279 |
| *Yersinia pseudotuberculosis* | A4TS63 | 280 |
| *Actinobacillus pleuropneumoniae* | B0BTI9 | 281 |
| *Silicibacter pomeroyi* | Q5LV46 | 282 |
| *Xanthomonas oryzae* | Q2NXR2 | 283 |
| *Thermoanaerobacterium saccharolyticum* | P30435 | 284 |
| *Escherichia coli* | B6I3D6 | 285 |
| *Escherichia coli* | B5YVL8 | 286 |
| *Escherichia coli* | B7NP65 | 287 |
| *Escherichia coli* | B2U560 | 288 |
| *Escherichia coli* | B1IZM7 | 289 |
| *Rhizobium etli* | Q2K433 | 290 |
| *Escherichia coli* | P00944 | 291 |
| *Hordeum vulgare* | Q40082 | 292 |
| *Dinoroseobacter shibae* | A8LP53 | 293 |
| *Rhodobacter sphaeroides* | Q3IYM4 | 294 |
| *Actinobacillus succinogenes* | A6VLM8 | 295 |
| *Bacillus pumilus* | A8FE33 | 296 |
| *Escherichia coli* | Q8FCE3 | 297 |
| *Pseudomonas syringae* | Q880Z4 | 298 |
| *Burkholderia vietnamiensis* | A4JSU5 | 299 |
| *Escherichia coli* | A7ZTB2 | 300 |
| *Haemophilus influenzae* | P44398 | 301 |
| *Haemophilus influenzae* | Q4QLI2 | 302 |
| *Listeria welshimeri* | A0AF79 | 303 |
| *Thermoanaerobacter yonseiensis* | Q9KGU2 | 304 |
| *Geobacillus kaustophilus* | Q5KYS6 | 305 |
| *Mannheimia succiniciproducens* | Q65PY0 | 306 |

SEQ ID NO:307 is the nucleotide sequence of the LoxPw-aadA-LoxPw DNA fragment PCR product.

SEQ ID NO:308 is the coding region for the *Actinoplanes missouriensis* xylose isomerase that was codon optimized for *Zymomonas*.

SEQ ID NO:309 is the coding region for the *Lactobacillus brevis* xylose isomerase that was codon optimized for *Zymomonas*.

SEQ ID NO:310 is the coding region for the *E. coli* xylose isomerase that was codon optimized for *Zymomonas*.

SEQ ID NO:311 is the nucleotide sequence of the glyceraldehyde-3-phosphate dehydrogenase gene promoter from *Z. mobilis* (ZmPgap).

SEQ ID NO:312 is the nucleotide sequence of the terminator from the *Z. mobilis* L-ribulose 5 phosphate 4-epimerase gene.

SEQ ID NO:313 is the nucleotide sequence of the pARA354 plasmid.

SEQ ID NO:314-327, 329, 330, and 332-334 are nucleotide sequences of PCR and sequencing primers.

SEQ ID NO:328 is the nucleotide sequence of the LDH-L DNA fragment PCR product.

SEQ ID NO:331 is the nucleotide sequence of the LDH-R DNA fragment PCR product.

SEQ ID NO:335 is the nucleotide sequence of the codon optimized coding region for *Geodermatophilus obscurus* xylose isomerase.

SEQ ID NO:336 is the nucleotide sequence of the codon optimized coding region for *Mycobacterium smegmatis* xylose isomerase.

SEQ ID NO:337 is the nucleotide sequence of the codon optimized coding region for *Salinispora arenicola* xylose isomerase.

SEQ ID NO:338 is the nucleotide sequence of the codon optimized coding region for *Xylanimonas cellulosilytica* xylose isomerase.

SEQ ID NO:339 is the nucleotide sequence of the promoter $P_{gapS}$ used in chimeric gene constructions.

SEQ ID NOs:340-345 are nucleotide sequences of PCR and sequencing primers.

DETAILED DESCRIPTION

Disclosed herein are xylose isomerase enzymes that are highly active in *Zymomonas*, and may be used to increase xylose utilization and ethanol production. Ethanol is an important compound for use in replacing fossil fuels.

The following definitions may be used for the interpretation of the claims and specification:

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The term "carbon substrate" or "fermentable carbon substrate" refers to a carbon source capable of being metabolized by host organisms of the present invention and particularly carbon sources selected from the group consisting of monosaccharides, oligosaccharides, and polysaccharides.

"Gene" refers to a nucleic acid fragment that expresses a specific protein or functional RNA molecule, which may optionally include regulatory sequences preceding (5' non-coding sequences) and following (3' non-coding sequences)

the coding sequence. "Native gene" or "wild type gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene not normally found in the host organism, but that is introduced into the host organism by gene transfer. Foreign genes can comprise native genes inserted into a non-native organism, or chimeric genes.

The term "genetic construct" refers to a nucleic acid fragment that encodes for expression of one or more specific proteins or functional RNA molecules. In the gene construct the gene may be native, chimeric, or foreign in nature. Typically a genetic construct will comprise a "coding sequence". A "coding sequence" refers to a DNA sequence that encodes a specific amino acid sequence.

"Promoter" or "Initiation control regions" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. Promoters which cause a gene to be expressed in most cell types at most times are commonly referred to as "constitutive promoters".

The term "expression", as used herein, refers to the transcription and stable accumulation of coding (mRNA) or functional RNA derived from a gene. Expression may also refer to translation of mRNA into a polypeptide. "Overexpression" refers to the production of a gene product in transgenic organisms that exceeds levels of production in normal or non-transformed organisms.

The term "transformation" as used herein, refers to the transfer of a nucleic acid fragment into a host organism, resulting in genetically stable inheritance. The transferred nucleic acid may be in the form of a plasmid maintained in the host cell, or some transferred nucleic acid may be integrated into the genome of the host cell. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

The term "operably linked" refers to the association of nucleic acid sequences on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

The term "selectable marker" means an identifying factor, usually an antibiotic or chemical resistance gene, that is able to be selected for based upon the marker gene's effect, i.e., resistance to an antibiotic, wherein the effect is used to track the inheritance of a nucleic acid of interest and/or to identify a cell or organism that has inherited the nucleic acid of interest.

As used herein the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA.

The term "fermentable sugar" refers to oligosaccharides and monosaccharides that can be used as a carbon source by a microorganism in a fermentation process.

The term "lignocellulosic" refers to a composition comprising both lignin and cellulose. Lignocellulosic material may also comprise hemicellulose.

The term "cellulosic" refers to a composition comprising cellulose and additional components, including hemicellulose.

The term "saccharification" refers to the production of fermentable sugars from polysaccharides.

The term "pretreated biomass" means biomass that has been subjected to thermal, physical and/or chemical pretreatment to increase accessibility of polysaccharides in the biomass prior to saccharification.

"Biomass" refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass could comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn cobs, crop residues such as corn husks, corn stover, grasses, wheat, wheat straw, barley straw, hay, rice straw, switchgrass, waste paper, sugar cane bagasse, sorghum, components obtained from milling of grains, trees, branches, roots, leaves, wood chips, sawdust, shrubs and bushes, vegetables, fruits, flowers and animal manure.

"Biomass hydrolysate" refers to the product resulting from saccharification of biomass. The biomass may also be pretreated or pre-processed prior to saccharification.

The term "xylose isomerase" refers to an enzyme that catalyzes the interconversion of D-xylose and D-xylulose. Xylose isomerases (XI) belong to the group of enzymes classified as EC 5.3.1.5.

The term "E-value", as known in the art of bioinformatics, is "Expect-value" which provides the probability that a match will occur by chance. It provides the statistical significance of the match to a sequence. The lower the E-value, the more significant the hit.

The term "Group I xylose isomerase" refers herein to a xylose isomerase protein that belongs to Group I as defined by at least one of the following criteria: a) it falls within a 50% threshold sequence identity grouping that includes the *A. missouriensis* XI that is prepared using molecular phylogenetic bioinformatics analysis as in Example 4; b) it substantially fits the amino acids for Group I in the specificity determining positions (SDP) identified using GroupSim analysis of the Group I and Group II XI sets determined from molecular phylogenetic analysis that are given in Table 6 in Example 4; and/or c) it has an E-value of 1E-15 or less when queried using a Profile Hidden Markov Model prepared using SEQ ID NOs: 2, 24, 32, 34, 42, 54, 66, 68, 78, 96, 100, 106, 108, 122, 126, 128, 130, 132, 135, 137, and 142; where the query is carried out using the hmmsearch algorithm with the Z parameter is set to 1 billion, as in Example 4. It is understood that although "Group 1" xylose isomerases are known and defined in the literature that the definition provided herein is more precise than the literature definition and is the definition that informs the following discussion. Thus, "Group I" as used herein will refer to Applicants' definition whereas "Group II" will refer to the definitions as commonly understood in the art.

The term "heterologous" means not naturally found in the location of interest. For example, a heterologous gene refers to a gene that is not naturally found in the host organism, but that is introduced into the host organism by gene transferIn addition, a heterologous nucleic acid molecule that is present in a chimeric gene is a nucleic acid molecule that is not naturally found associated with the other segments of the chimeric gene, such as the nucleic acid molecules having the coding region and promoter segments not naturally being associated with each other.

As used herein, an "isolated nucleic acid molecule" is a polymer of RNA or DNA that is single- or double-stranded, optionally containing synthetic, non-natural or altered nucleotide bases. An isolated nucleic acid molecule in the form of a polymer of DNA may be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, $2^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe. The term "complementary" is used to describe the relationship between nucleotide bases that are capable of hybridizing to one another. For example, with respect to DNA, adenosine is complementary to thymine and cytosine is complementary to guanine.

The terms "homology" and "homologous" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that homologous nucleic acid sequences encompassed by this invention are also defined by their ability to hybridize, under moderately stringent conditions (e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.).

Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS*. 5:151-153 (1989); Higgins, D. G. et al., *Comput. Appl. Biosci.*, 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

Additionally the "Clustal W method of alignment" is available and corresponds to the alignment method labeled Clustal W (described by Higgins and Sharp, CABIOS. 5:151-153 (1989); Higgins, D. G. et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity. Useful examples of percent identities include, but are not limited to: 50%, 55%, 60%, 65%, 70%, 75%, 80%, 85%, 90%, or 95%, or any integer percentage from 50% to 100% may be useful in describing the present invention, such as 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., J. Mol. Biol., 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, Comput. Methods Genome Res., [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T. *Molecular Cloning: A Laboratory Manual*, $2^{nd}$ ed.; Cold Spring Harbor Laboratory: Cold Spring Harbor, N.Y., 1989 (hereinafter "Maniatis"); and by Silhavy, T. J., Bennan, M. L. and Enquist, L. W. *Experiments with Gene Fusions*; Cold Spring Harbor Laboratory: Cold Spring Harbor, N.Y., 1984; and by Ausubel, F. M. et al., In *Current Protocols in Molecular Biology*, published by Greene Publishing and Wiley-Interscience, 1987.

The present invention relates to engineered strains of xylose-utilizing *Zymomonas* or *Zymobacter* that have improved xylose utilization when fermented in xylose containing media. A challenge for improving ethanol production by fermentation of a biocatalyst in media that includes biomass hydrolysate, produced typically by pretreatment and saccharification of biomass, is obtaining optimal utilization of xylose. Xylose is one of the predominant pentose sugars in hydrolyzed lignocellulosic materials, the other being arabinose. Applicants have identified a group of xylose isomerases that when expressed in xylose-utilizing *Zymomonas* strains provide for increased efficiency in xylose utilization and higher ethanol yields, when fermentation is in xylose containing media.

Discovery of Highly Effective Xylose Isomerases

Figure 1:
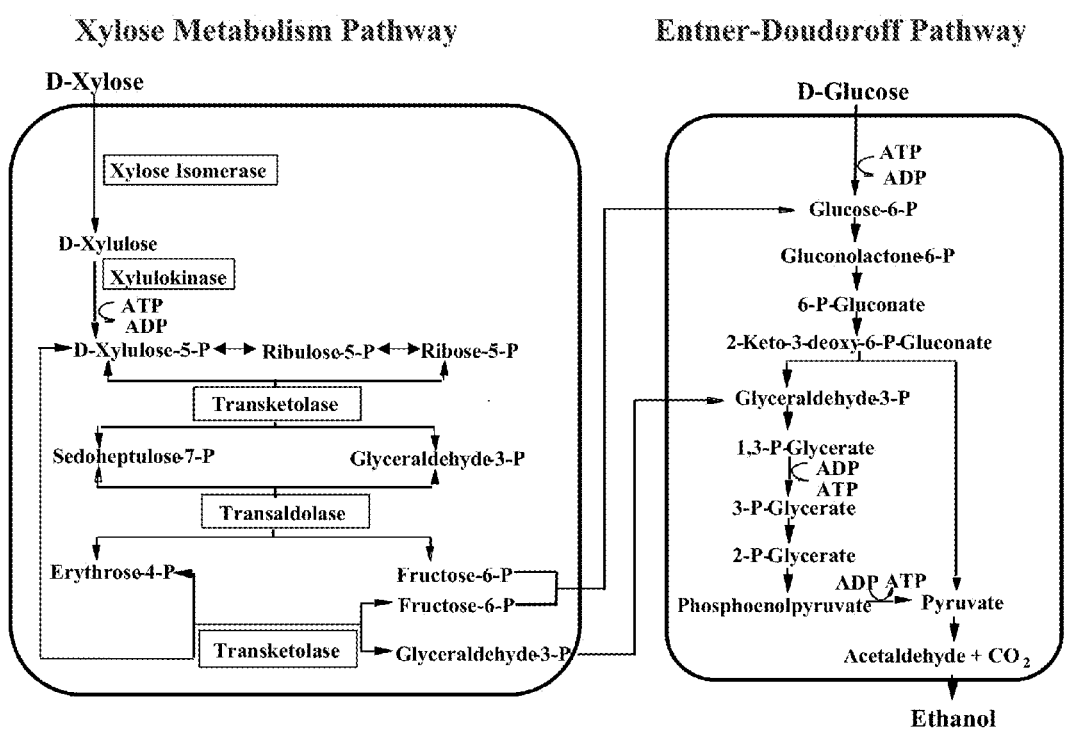
FIG. 1 shows a diagram of the ethanol fermentation pathway in *Zymomonas* engineered for xylose utilization.

Xylose isomerase (XI), which catalyzes the conversion of xylose to xylulose, is one of four enzymes that when expressed in a bacterial cell provide the ability to utilize xylose as a carbon source. XI along with xylulokinase, transketolase, and transaldolase provide a pathway from xylose that produces fructose-6-P and glyceraldehyde-3-P that feed into ethanol biosynthesis as shown in FIG. 1. As the first enzyme of the xylose utilization pathway, xylose isomerase activity is particularly important in providing the ability to ultimately convert xylose to ethanol. Applicants have identified xylose isomerases that have higher activity when expressed in the ethanol producing bacteria, *Zymomonas*, and support enhanced xylose utilization and ethanol production, as compared to the typically used *E. coli* XI.

The xylose isomerase from *E. coli* has been used in engineering *Zymomonas* for xylose utilization. Xylose isomerases are classified in two groups based on their size, amino acid sequence similarity, and divalent cation preference (Park and Batt (2004) Applied and Environmental Microbiology 70:4318-4325). The *E. coli* XI belongs to Group II.

Applicants have discovered that XIs belonging to Group I (as defined herein) provide enhanced properties for xylose utilization and ethanol production in xylose-utilizing *Zymomonas*. The *Actinoplanes missouriensis* XI was found herein to be a Group I XI as described below. When expressed in *Zymomonas* using a codon-optimized coding sequence (SEQ ID NO:308), the XI from *Actinoplanes missouriensis* had a xylose isomerase specific activity that was higher than specific activities of similarly expressed *E. coli* XI (using a codon-optimized coding sequence: SEQ ID NO:310), or another Group II XI, that of *Lactobacillus brevis* (codon-optimized coding sequence: SEQ ID NO:309). The codon-optimized coding sequences for the *A. missouriensis, E. coli*, and *L. brevis* XIs were each expressed in *Zymomonas* engineered with all four enzymes for xylose utilization, including the *E. coli* xylose isomerase expressed from a non-optimized coding sequence. Strains expressing the *A. missouriensis* XI grew better in xylose containing medium, utilized more xylose, and produced more ethanol than strains expressing the XI from either *E. coli* or *L. brevis*.

*Zymomonas* strains expressing additional XIs that were identified as belonging to Group I, as described below, were also found to grow better, utilize more xylose and produce more ethanol in xylose containing medium than strains expressing the Group II XI from *E. coli* or *L. brevis*. These were strains containing the XIs from Geodermatophilus obscurus (SEQ ID NO:64), *Mycobacterium smegmatis* (SEQ ID NO:10), Salinispora arenicola (SEQ ID NO:18), and *Xylanimonas cellulosilytica* (SEQ ID NO:40).

The growth enhancement, xylose utilization improvement, and ethanol production improvement each may vary in extent in a Group I XI expressing strain as compared to a Group II XI expressing strain. Differences may be based on factors such as specific XI encoding gene expression properties, culturing conditions such as carbon source composition in the medium including amount of xylose and other carbon sources, and strain characteristics such as additional genetic modifications involved in xylose utilization and/or ethanol production.

Group I Xylose Isomerases

Any XI belonging to Group I may be used in the present strains to improve xylose utilization. The Group I XIs have been distinguished from Group II XIs by their length. Group I XIs were found typically to be about 380 to 390 amino acids in length while Group II XIs are typically about 440 to 460 amino acids in length. Among Group I XIs there is amino acid identity of at least about 50%, while Group II XIs have only 20-30% amino acid identity with Group I XIs. Thus XIs can be readily classified as belonging to Group I or Group II using these structural criteria.

XIs identified in Park and Batt (supra) as belonging to Group I are those from *Streptomyces, Actinoplanes, Thermus*, and *Arthrobacter* while XIs identified as belonging to Group II are those from *Klebsiella, Escherichia, lactobacillus, Lactococcus, Clostridium, Bacillus, Staphylococcus*, and *Thermoanaerobacter*.

Bioinformatics analysis was used to more fully characterize Group I as opposed to Group II XIs to identify those XIs that may be used in the present strains. Members of Group I xylose isomerases were identified using molecular phylogenetic analysis of XI amino acid sequences. The molecular phylogenetic analysis was performed on 444 XI sequences collected from a public database using multiple query sequence BLAST analysis (blastall) using 180 XI seed sequences with functional annotations retrieved from the SWISSPROT database: SEQ ID NOs:2, 24, 32, 34, 42, 54, 66, 68, 78, 96, 100, 106, 108, 122, 126, 128, 130, 132, 135, 137, 142 and 148-306.

Figure 2:
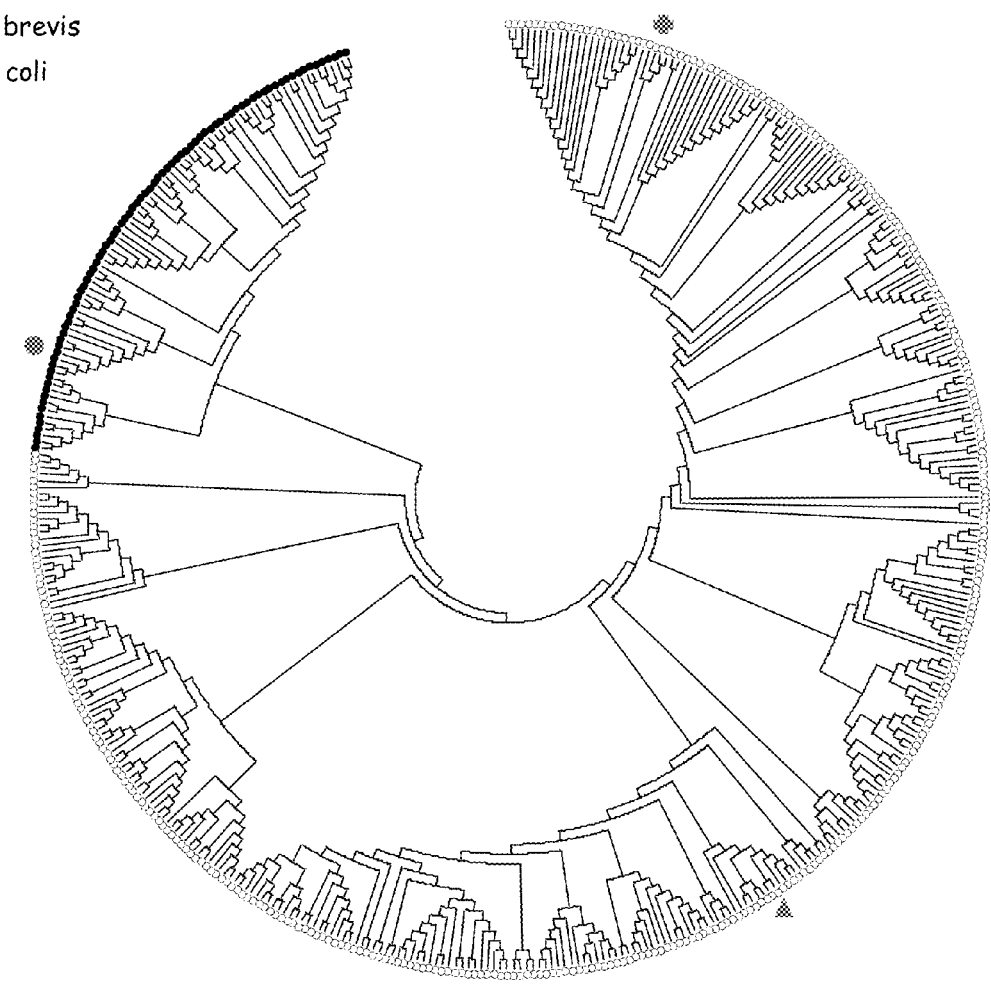
FIG. 2 is a diagram of a phylogenetic tree of xylose isomerases showing Group I and Group II branches.

The resulting phylogenetic tree shown in FIG. 2 places the *A. missouriensis* XI in one phylogenetic grouping, called Group I, and the *E. coli* XI in a separate grouping, called Group II. Group I and Group II are labeled to coincide with the groupings of Park and Bratt (supra). The *Lactobacillus brevis* XI, tested herein in Example 3 and shown to have comparable effects as the XI from *E. coli*, is also in Group II. Twenty-one of the seed sequences (SEQ ID NOs:2, 24, 32, 34, 42, 54, 66, 68, 78, 96, 100, 106, 108, 122, 126, 128, 130, 132, 135, 137, and 142) were found to belong to Group I XIs. The identified XI sequences belonging to Group I form a 50% threshold identity cluster, as described in Example 4. XI sequences belonging to Group II form a separate 50% threshold identity cluster. Each identified Group I XI is encoded by the genome of, and therefore is endogenous to, one of the following microorganisms: *Actinoplanes, Arthrobacter, Streptomyces, Thermus, Thermobaculum, Herpetosiphon, Acidobacteria, Roseiflexus, Meiothermus, Deinococcus, Meiothermus, Stackebrandtia, Kribbella, Xylanimonas, Nocardiopsis, Catenulispora, Streptosporangium, Geodermatophilus, Actinosynnema, Saccharomonospora, Acidothermus, Tthermobifida, Nocardiodes, Janibacter, Mycobacterium, Leifsonia, Clavibacter, Micromonospora, Salinispora, Cellulomonas, Jonesia, Nakamurella, Actinomyces, Mobiluncus, Brachybacterium, Beutengergai, Frankia*, and *Actinobacterium*.

Figure 3:
FIG. 3 is a diagram of a phylogenetic tree of Group I xylose isomerases.

Any XI that belongs to Group I XIs as determined by molecular phylogenetic analysis as described in Example 4 herein may be used in the present strains. The molecular phylogeny of the Group I XIs is shown in more detail in FIG. 3. The Group I XIs in FIG. 3 are listed in Table 3 as having SEQ ID NOs that are even numbers between 2 and 130 and 131-147. Coding regions for these proteins are listed in Table 3 as having SEQ ID NOs that are odd numbers between 1 and 129. Any other identified XI that can be identified as belonging to Group I using molecular phylogenetic analysis as described in Example 4 herein may be used in the present strains. Alternatively, XIs that may be used in the present strains may be identified as xylose isomerase proteins with amino acid sequences having at least about 70%-75%, 75%-80%, 80-85%, 85%-90%, 90%-95%, or at least about 96%, 97%, 98%, or 99% sequence identity to any of the XI amino acid sequences of SEQ ID NOs that are even numbers between, and including, 2 and 130 and 131-147. In one embodiment XIs that may be used in the present strains may be identified as proteins with xylose isomerase activity and with amino acid sequences having at least about 70%-75%, 75%-80%, 80-85%, 85%-90%, 90%-95%, or at least about 96%, 97%, 98%, or 99% sequence identity to any of the XI amino acid sequences of SEQ ID NOs: 24, 66, 134, 140, 143, 145, and 147. Identities are based on the Clustal W method of alignment using the default parameters of GAP PENALTY=10, GAP LENGTH PENALTY=0.1, and Gonnet 250 series of protein weight matrix.

Group I and Group II XIs were further characterized using GroupSim analysis as described in Example 4 herein. Through this analysis specific amino acid positions were determined to be specificity determining positions (SDP) for distinguishing the structures of Group I and Group II XI proteins. The locations of these SDP amino acids are given here at corresponding positions in the representative Group I protein P12851 from *Actinoplanes missouriensis* (SEQ ID NO:66) and in the representative Group II protein P19148 from *Thermoanaerobacterium thermosulfurigenes* (SEQ ID NO:267). The positions in the Group II protein are generally about 51 greater than in the Group I protein. The corresponding positions in other Group I and II proteins can readily be identified by one skilled in the art by sequence alignment and context. The SDP identifiers distinguishing Group I and Group II XIs with a score of 0.9 or greater (where a perfect score of 1 would indicate that all proteins within the group have the listed amino acid in the specified position and between groups the amino acid is always different) are the following amino acid (AA) positions in P12851 vs in P19148:
1) AA 226 is leucine; AA277 is histidine
2) AA223 is methionine; AA274 is leucine
3) AA191 is isoleucine; AA242 is glutamine
4) AA195 is threonine, serine, or valine; AA246 is aspartic acid
5) AA88 is methionine, threonine, or guanine; AA139 is arginine or tryptophan
6) AA290 is histidine; AA337 is asparagine or methionine
7) AA221 is glutamic acid or aspartic acid; AA 272 is alanine, threonine, or glycine
8) AA242 is phenylalanine, valine, or leucine; A293 is glycine, cysteine, or tryptophan
9) AA243 is histidine; AA294 is serine, asparagine, glycine, or leucine
10) AA193 is leucine, phenylalanine, or methionine; AA244 is aspartic acid
11) AA256 is glutamine; AA 308 is threonine, isoleucine, valine, leucine, methionine, tyrosine, or histidine
12) AA213 is glycine; AA264 is lysine, asparagine, serine, glutamic acid, alanine, leucine, arginine, or glutamine
13) AA288 is proline, tyrosine, alanine, or serine; AA335 is valine or glycine
14) AA249 is glutamine; AA301 is aspartic acid, histidine, asparagine, arginine, serine, or alanine Using these amino acid position identifiers, a Group I XI can be readily identified by one skilled in the art. An XI having the Group I amino acid position identifiers substantially as listed above will be considered herein to be a Group I XI irrespective of length. Thus if substantially all of the positions indicated for Group II XIs are filled by the amino acids indicated for a Group I XI, the protein is considered to be a Group I XI regardless of length. For example, an XI having the Group I AA226 leucine identifier at the 277 position instead of histidine is a Group I XI if this pattern holds for the other amino acid identifiers. Substantially here means that there need not be a complete exact match at all positions, as indicated by the scores of 0.9 as opposed to a score of 1. A Group I XI has at least 90% of the amino acids at the SDPs matching the above list.

An additional bioinformatics analysis of Group I XIs was performed using the hmmsearch algorithm of the HMMER software package (Janelia Farm Research Campus, Ashburn, Va.). The Z parameter of the hmmsearch algorithm was set to 1 billion. The output of the HMMER analysis using a set of protein sequences is a Profile Hidden Markov Model (Profile HMM). The theory behind Profile HMMs as described in Durbin et al. (Biological sequence analysis: probabilistic models of proteins and nucleic acids, Cambridge University Press, 1998) and Krogh et al. (1994 *J. Mol. Biol.* 235:1501-1531), both incorporated herein by reference, is characterization of a set of proteins based on the probability of each amino acid occurring at each position in the alignment of the proteins of the set.

The 21 seed sequences having known xylose isomerase activity and found to belong to Group I XIs in the molecular phylogenetic analysis described above were used as the set of proteins to prepare a profile HMM. These proteins have SEQ ID NOs:2, 24, 32, 34, 42, 54, 66, 68, 78, 96, 100, 106, 108, 122, 126, 128, 130, 132, 135, 137, and 142. All of the XIs that were identified by molecular phylogenetic analysis as belonging to Group I, which are listed in Table 3, match the profile HMM prepared from Group I seed sequences with E-value scores of less than or equal to 2.2e-181, with the Z parameter set to 1 billion. All of the XIs identified by molecular phylogenetic analysis as belonging to Group II match the same profile HMM with E-value scores of greater than or equal to 1.5e-07. Table 2 of the appendix lists the E-value scores for each XI SEQ ID NO. Thus the prepared profile HMM gives a structural characterization for functional Group I XIs and corroborates the molecular phylogenetic analysis. Therefore any XI protein that matches the profile HMM prepared using the 21 Group I XI seed sequences described above with an E-value of 1E-15 or less, where 1E-15 is between the highest score for a Group I XI and the lowest score for a Group II XI, may be used in the present strains. Lower E-value scores indicate better matches.

Additionally, the Group I XI sequences described herein or those recited in the art may be used to identify other homologs in nature. For example each of the XI encoding nucleic acid fragments described herein may be used to isolate genes encoding homologous proteins. Isolation of homologous genes using sequence-dependent protocols is well known in the art. Examples of sequence-dependent protocols include, but are not limited to: 1) methods of nucleic acid hybridization; 2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., Proc. Acad. Sci. USA 82:1074 (1985); or strand displacement amplification (SDA), Walker, et al., *Proc. Natl. Acad. Sci. U.S.A.*, 89:392 (1992)]; and 3) methods of library construction and screening by complementation.

As is known in the art, there may be variations in DNA sequences encoding an amino acid sequence due to the degeneracy of the genetic code. Codons may be optimized for expression of an amino acid sequence in a target host cell to provide for optimal encoded protein expression Group I XI Expression In the present strains, any of the Group I XIs described above may be expressed in a strain of *Zymomonas* or related ethanolagen, such as *Z. mobilis* or *Zymobacter*, along with genes encoding xylulokinase, transketolase, and transaldolase as described above, which then is capable of utilizing xylose as described below. *Zymobacter palmae* is an ethanol-producing bacterium that has been engineered for xylose utilization by expressing genes for xylose utilization as described below for *Zymomonas*, using *Z. mobilis* glyceraldehyde-3-phosphate dehydrogenase and enolase promoters (Yanase et al. Applied and Environmental Microbiology (2007) 73:2592-2599).

Coding regions that may be used to express Group I XIs include those listed in Table 1 as SEQ IDs with odd numbers from 1 through 129, other sequences encoding XI proteins listed in Table 1 as SEQ IDs with even numbers 2 through 130 and 131-147, as well as sequences identified in the art as encoding Group I XIs using bioinformatics or experimental methods described herein and those well known in the art.

For expression, a Group I XI coding region is constructed in a chimeric gene with operably linked promoter and typically a termination sequence. Alternatively the Group I XI coding region is constructed as part of an operon that is operably linked to a promoter and a termination sequence, and includes one or more additional coding regions. Promoters that may be used are promoters that are expressed in Zymomonas or Zymobacter cells such as the promoters of Z. mobilis glyceraldehyde-3-phosphate dehydrogenase (GAP promoter or $P_{gap}$), including mutant more highly active GAP promoters disclosed in US 20090246876, which is incorporated herein by reference, that may be called superGAP promoters or $P_{gapS}$, and Z. mobilis enolase (ENO promoter) genes. Termination signals are also those that are expressed in the target cell.

A chimeric gene or operon for XI expression is typically constructed in or transferred to a vector for further manipulations. Vectors are well known in the art. Certain vectors are capable of replicating in a broad range of host bacteria and can be transferred by conjugation. The complete and annotated sequence of pRK404 and three related vectors: pRK437, pRK442, and pRK442(H) are available. These derivatives have proven to be valuable tools for genetic manipulation in gram-negative bacteria (Scott et al., Plasmid 50(1):74-79 (2003)).

Particularly useful for expression in Zymomonas are vectors that can replicate in both E. coli and Zymomonas, such as pZB188 which is described in U.S. Pat. No. 5,514,583. Vectors may include plasmids for autonomous replication in a cell, and plasmids for carrying constructs to be integrated into bacterial genomes. Plasmids for DNA integration may include transposons, regions of nucleic acid sequence homologous to the target bacterial genome, or other sequences supporting integration. An additional type of vector may be a transposome produced using, for example, a system that is commercially available from EPICENTRE®. It is well known how to choose an appropriate vector for the desired target host and the desired function.

Bacterial cells may be engineered by introducing a vector having a chimeric gene comprising a xylose isomerase coding region by well known methods, such as using freeze-thaw transformation, calcium-mediated transformation, electroporation, or conjugation. Any bacterial cell to be engineered for xylose utilization by expressing a xylose isomerase enzyme is a target host cell for transformation to engineer a strain as described herein. Particularly suitable host cells are Zymomonas and Zymobacter cells. The introduced chimeric gene may be maintained in the cell on a stably replicating plasmid, or integrated into the genome following introduction.

For engineering a strain with an integrated xylose isomerase chimeric gene or operon in the bacterial cell genome, methods may be used that are well known in the art such as homologous recombination, transposon insertion, or transposome insertion. In homologous recombination, DNA sequences flanking a target integration site are placed bounding a spectinomycin-resistance gene, or other selectable marker, and xylose isomerase chimeric gene leading to insertion of the selectable marker and the xylose isomerase chimeric gene into the target genomic site. In addition, the selectable marker may be bounded by site-specific recombination sites, so that after expression of the corresponding site-specific recombinase, the resistance gene is excised from the genome.

Engineering of Full Xylose Utilization Pathway

In addition to transforming with a chimeric gene or operon comprising a Group I XI coding region, the present strains are also engineered for expression of three other enzymes needed for xylose utilization: xylulokinase, which phosphorylates xylulose to form xylulose 5-phosphate, and transaldolase and transketolase, two enzymes of the pentose phosphate pathway which convert xylulose 5-phosphate to intermediates that couple pentose metabolism to the glycolytic Entner-Douderoff pathway permitting the metabolism of xylose to ethanol (see FIG. 1). Xylose utilizing Zymomonas strains are described in U.S. Pat. No. 5,514,583, U.S. Pat. No. 5,712,133, U.S. Pat. No. 6,566,107, WO 95/28476, Feldmann et al. ((1992) Appl Microbiol Biotechnol 38: 354-361), Zhang et al. ((1995) Science 267:240-243. These strains were transformed with coding sequences from E. coli genes, including a Group II xylose isomerase.

The Group I XI may be the sole XI expressed for xylose utilization-, or it may be expressed in addition to an expressed Group II XI such as that from E. coli. Thus a Group I XI may be introduced in a Zymomonas or Zymobacter strain that has a full xylose utilization pathway that includes a Group II xylose isomerase encoding gene and is capable of utilizing xylose. Alternatively, a Group I XI may be introduced in a Zymomonas or Zymobacter strain that expresses xylulokinase, transaldolase, and transketolase, and only lacks xylose isomerase activity for utilizing xylose. With introduction of a Group I XI the strain is capable of utilizing xylose.

The additional three enzymes may be expressed from individual chimeric genes or from operons including more than one coding region as well known to one skilled in the art. DNA sequences encoding these enzymes may be obtained from any of numerous microorganisms that are able to metabolize xylose, such as enteric bacteria, and some yeasts and fungi. Sources for the coding regions include Xanthomonas, Klebsiella, Escherichia, Rhodobacter, Flavobacterium, Acetobacter, Gluconobacter, Rhizobium, Agrobacterium, Salmonella, Pseudomonads, and Zymomonas. Particularly useful are the coding regions of E. coli.

Endogenous genes may provide part of a xylose fermentation pathway, or may be altered by any known genetic manipulation technique to provide a protein with enzyme activity useful for xylose metabolism. For example, an endogenous transketolase may complement other introduced enzyme activities in creating a xylose utilization pathway.

Examples of xylose-utilizing strains that are known and may be used include CP4(pZB5) (U.S. Pat. No. 5,514,583), ATCC31821/pZB5 (U.S. Pat. No. 6,566,107), 8b (US 20030162271; Mohagheghi et al., (2004) Biotechnol. Lett. 25; 321-325), and ZW658 (ATTCC #PTA-7858; U.S. Pat. No. 7,741,119).

Zymomonas or Zymobacter strains that are additionally engineered to utilize other sugars that, like xylose, are not natural substrates, may also be used in the present process. An example is a strain of Z. mobilis engineered for arabinose utilization as described in U.S. Pat. No. 5,843,760, which is herein incorporated by reference. Strains may be modified in other additional ways to improve xylose utilization and ethanol production.

Fermentation Of Improved Xylose-Utilizing Strain

An engineered xylose-utilizing strain having a Group I xylose isomerase chimeric gene and genes or operons for expression of xylulokinase, transaldolase and transketolase may be used in fermentation to produce a product that is a natural product of the strain, or a product that the strain is engineered to produce. For example, Zymomonas mobilis and Zymobacter palmae are natural ethanologens. As an example, production of ethanol by a Z. mobilis strain of the invention is described.

For production of ethanol, recombinant xylose-utilizing Z. mobilis having a Group I xylose isomerase chimeric gene is brought in contact with medium that contains mixed sugars including xylose. Typically the medium contains mixed sugars including arabinose, xylose, and glucose. The medium may contain biomass hydrolysate that includes these sugars that are derived from treated cellulosic or lignocellulosic biomass.

When the mixed sugars concentration is high such that growth is inhibited, the medium includes sorbitol, mannitol, or a mixture thereof as disclosed in U.S. Pat. No. 7,629,156. Galactitol or ribitol may replace or be combined with sorbitol or mannitol. The *Z. mobilis* grows in the medium where fermentation occurs and ethanol is produced. The fermentation is run without supplemented air, oxygen, or other gases (which may include conditions such as anaerobic, microaerobic, or microaerophilic fermentation), for at least about 24 hours, and may be run for 30 or more hours. The timing to reach maximal ethanol production is variable, depending on the fermentation conditions. Typically, if inhibitors are present in the medium, a longer fermentation period is required. The fermentations may be run at temperatures that are between about 30° C. and about 37° C., at a pH of about 4.5 to about 7.5.

The present *Z. mobilis* may be grown in medium containing mixed sugars including xylose in laboratory scale fermenters, and in scaled up fermentation where commercial quantities of ethanol are produced. Where commercial production of ethanol is desired, a variety of culture methodologies may be applied. For example, large-scale production from the present *Z. mobilis* strains may be produced by both batch and continuous culture methodologies. A classical batch culturing method is a closed system where the composition of the medium is set at the beginning of the culture and not subjected to artificial alterations during the culturing process. Thus, at the beginning of the culturing process the medium is inoculated with the desired organism and growth or metabolic activity is permitted to occur adding nothing to the system. Typically, however, a "batch" culture is batch with respect to the addition of carbon source and attempts are often made at controlling factors such as pH and oxygen concentration. In batch systems the metabolite and biomass compositions of the system change constantly up to the time the culture is terminated. Within batch cultures cells moderate through a static lag phase to a high growth log phase and finally to a stationary phase where growth rate is diminished or halted. If untreated, cells in the stationary phase will eventually die. Cells in log phase are often responsible for the bulk of production of end product or intermediate in some systems. Stationary or post-exponential phase production can be obtained in other systems.

A variation on the standard batch system is the Fed-Batch system. Fed-Batch culture processes are also suitable for growth of the present *Z. mobilis* strains and comprise a typical batch system with the exception that the substrate is added in increments as the culture progresses. Fed-Batch systems are useful when catabolite repression is apt to inhibit the metabolism of the cells and where it is desirable to have limited amounts of substrate in the medium. Measurement of the actual substrate concentration in Fed-Batch systems is difficult and is therefore estimated on the basis of the changes of measurable factors such as pH and the partial pressure of waste gases such as $CO_2$. Batch and Fed-Batch culturing methods are common and well known in the art and examples may be found in Biotechnology: A Textbook of Industrial Microbiology, Crueger, Crueger, and Brock, Second Edition (1989) Sinauer Associates, Inc., Sunderland, Mass., or Deshpande, Mukund V., *Appl. Biochem. Biotechnol.*, 36, 227, (1992), herein incorporated by reference.

Commercial production of ethanol may also be accomplished with a continuous culture. Continuous cultures are open systems where a defined culture medium is added continuously to a bioreactor and an equal amount of conditioned medium is removed simultaneously for processing. Continuous cultures generally maintain the cells at a constant high liquid phase density where cells are primarily in log phase growth. Alternatively, continuous culture may be practiced with immobilized cells where carbon and nutrients are continuously added, and valuable products, by-products or waste products are continuously removed from the cell mass. Cell immobilization may be performed using a wide range of solid supports composed of natural and/or synthetic materials as is known to one skilled in the art.

Continuous or semi-continuous culture allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by medium turbidity, is kept constant. Continuous systems strive to maintain steady state growth conditions and thus the cell loss due to medium being drawn off must be balanced against the cell growth rate in the culture. Methods of modulating nutrients and growth factors for continuous culture processes as well as techniques for maximizing the rate of product formation are well known in the art of industrial microbiology and a variety of methods are detailed by Brock, supra.

Particularly suitable for ethanol production is a fermentation regime as follows. The desired *Z. mobilis* strain of the present invention is grown in shake flasks in semi-complex medium at about 30° C. to about 37° C. with shaking at about 150 rpm in orbital shakers and then transferred to a 10 L seed fermentor containing similar medium. The seed culture is grown in the seed fermentor anaerobically until $OD_{600}$ is between 3 and 6, when it is transferred to the production fermentor where the fermentation parameters are optimized for ethanol production. Typical inoculum volumes transferred from the seed tank to the production tank range from about 2% to about 20% v/v. Typical fermentation medium contains minimal medium components such as potassium phosphate (1.0-10.0 g/l), ammonium sulfate (0-2.0 g/l), magnesium sulfate (0-5.0 g/l), a complex nitrogen source such as yeast extract or soy based products (0-10 g/l). A final concentration of about 5 mM sorbitol or mannitol is present in the medium. Mixed sugars including xylose and at least one additional sugar such as glucose (or sucrose), providing a carbon source, are continually added to the fermentation vessel on depletion of the initial batched carbon source (50-200 g/l) to maximize ethanol rate and titer. Carbon source feed rates are adjusted dynamically to ensure that the culture is not accumulating glucose in excess, which could lead to build up of toxic byproducts such as acetic acid. In order to maximize yield of ethanol produced from substrate utilized, biomass growth is restricted by the amount of phosphate that is either batched initially or that is fed during the course of the fermentation. The fermentation is controlled at pH 5.0-6.0 using caustic solution (such as ammonium hydroxide, potassium hydroxide, or sodium hydroxide) and either sulfuric or phosphoric acid. The temperature of the fermentor is controlled at 30° C.-35° C. In order to minimize foaming, antifoam agents (any class-silicone based, organic based etc) are added to the vessel as needed. An antibiotic, for which there is an antibiotic resistant marker in the strain, such as kanamycin, may be used optionally to minimize contamination.

Any set of conditions described above, and additionally variations in these conditions that are well known in the art, are suitable conditions for production of ethanol by a xylose-utilizing recombinant *Zymomonas* strain.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

The meaning of abbreviations is as follows: "kb" means kilobase(s), "bp" means base pairs, "nt" means nucleotide(s), "hr" means hour(s), "min" means minute(s), "sec" means second(s), "d" means day(s), "L" means liter(s), "ml" or "mL" means milliliter(s), "4" means microliter(s), "µg" means microgram(s), "ng" means nanogram(s), "mg" means milligram(s), "mM" means millimolar, "µM" means micromolar, "nm" means nanometer(s), "µmol" means micromole(s), "pmol" means picomole(s), "Cm" means chloramphenicol, "Cm$^r$" means chloramphenicol resistant, "Cm$^s$" means chloramphenicol sensitive, "Sp$^r$" means spectinomycin resistance, "Sp$^s$" means spectinomycin sensitive, "XI" is xylose isomerase, "XK" is xylulokinase, "TAL" is transaldolase, "TKT" is transketolase, "RM" means rich medium containing 10 g/L yeast extract plus 2 g/L $KH_2PO_4$, "MM" means mating medium containing 10 g/L yeast extract, 5 g/L tryptone, 2.5 g/L $(NH_4)_2SO_4$ and 0.2 g/L $KH_2PO_4$.

Standard recombinant DNA and molecular cloning techniques used here are well known in the art and are described by Sambrook, J., Fritsch, E. F. and Maniatis, T., *Molecular Cloning: A Laboratory Manual*, 2$^{nd}$ ed., Cold Spring Harbor Laboratory: Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory: Cold Spring Harbor, N.Y. (1984); and by Ausubel, F. M. et al., *Current Protocols in Molecular Biology*, published by Greene Publishing Assoc. and Wiley-Interscience, Hoboken, N.J. (1987).

Example 1

Construction of Chimeric Xylose Isomerase Genes and Assembly of Double Crossover Suicide Vectors Constructs were made for integration and expression in *Zymomonas mobilis* of the coding regions for xylose isomerases from *Actinoplanes missouriensis* (AMxylA), *Lactobacillus brevis* (LBxylA), and *Escherichia coli* (ECxylA). The coding sequences were optimized for expression in *Z. mobilis* according to the codon bias of *Z. mobilis* ZM4 and synthesized by GenScript Corporation (Piscataway, N.J.). Each was cloned into pUC57 at the EcoRV site and provided as the plasmids pUC57-AMxylA (with codon optimized AMxylA coding region SEQ ID NO:308), pUC57-LBxylA (with codon optimized LBxylA coding region SEQ ID NO:309), and pUC57-ECxylA (with codon optimized ECxylA coding region SEQ ID NO:310). The optimized xylA coding sequences encode the native xylose isomerases (XIs).

The xylA coding sequences were constructed into chimeric genes with the structure of $P_{gap}$-xylA-araD3'UTR by linking with a 305 bp promoter from the *Z. mobilis* glyceraldehyde-3-phosphate dehydrogenase gene ($P_{gap}$; SEQ ID NO:311) and a 166 bp terminator from the *E. coli* L-ribulose 5 phosphate 4-epimerase gene (araD3'UTR; SEQ ID NO:312).

For this purpose, $P_{gap}$ and araD3'UTR overlapping fragments were synthesized by PCR. One PCR reaction consisted of 50 µL AccuPrime Pfx SuperMix (Invitrogen, Carlsbad, Calif.), 1 µL of 40 ng/µL pARA354 as template (SEQ ID NO:313), and 1 µL of 10 µM forward and reverse primers. Plasmid pARA354 (SEQ ID NO:313) is described in commonly owned and co-pending U.S. patent application Ser. No. 12/796,025, which is herein incorporated by reference, and is a pBS SK(+) vector that includes a $P_{gap}$-ara BAD operon, which is the $P_{gap}$ promoter adjacent to coding regions for araB, araA, and araD (encoding the proteins L-ribulose kinase, L-arabinose isomerase, and L-ribulose-5-phosphate-4-epimerase, respectively) from *E. coli*. The operon includes the 3' untranslated region (UTR) that is 3' to the araD coding region. pARA354 is described further below. Reactions were carried out on an Eppendorf Mastercycler (Hemburg, Germany), following a hot start PCR program with 30 cycles of denaturing at 95° C. for 30 sec/annealing at 58° C. (56° C. for araD3'UTR) for 30 sec/extension at 68° C. for 2 min.

Primers ara98 and ara120 (SEQ ID NOS:314 and 315) produced a $P_{gap}$-AM overlapping fragment. Primers ara98 and ara121 (SEQ ID NOS: 314 and 316) produced a $P_{gap}$-EC overlapping fragment. Primers ara98 and ara122 (SEQ ID NOS: 314 and 317) produced a $P_{gap}$-LB overlapping fragment. In addition to the 305 bp $P_{gap}$ sequence, all three $P_{gap}$ overlapping PCR fragments included a 17 bp 5' sequence to add StuI and SpeI sites and a 22 bp 3' sequence to match the first 22 nucleotides of their counterpart xylA coding sequence, that were provided in the primers.

Primer ara96 and ara97 (SEQ ID NOS: 318 and 319) produced a 210-bp araD3'UTR overlapping fragment. It included a 24 bp 5' sequence with an XbaI site at the end, and a 20 bp 3' sequence providing EcoRI, HindII, and FseI sites, in addition to the 166-bp araD3'UTR. Similar PCR was also conducted to synthesize xylA overlapping fragments, but annealing temperature was lowered to 55° C. In these reactions, a 1,229 bp AMxylA overlapping fragment was amplified from pUC57-AMxylA using primers ara114 and ara115 (SEQ ID NOs:320 and 321). A 1,367-bp ECxylA overlapping fragment was amplified from pUC57-ECxylA using primers ara116 and ara117 (SEQ ID NOs:322 and 323). A 1,394-bp LBxylA overlapping fragment was amplified from pUC57-LBxylA using primers ara118 and ara119 (SEQ ID NOs:324 and 325). All xylA overlapping fragments have an 18-bp 5' sequence matching the last 18 nucleotides of $P_{gap}$, a 24-bp 3' sequence providing an XbaI site and matching the first 18 nucleotides of araD3'UTR, as well as a xylA coding sequence between them. The $P_{gap}$, araD3'UTR, and xylA overlapping fragments were confirmed by running 5 µL of each PCR sample on an agarose gel, and then purified by using QIAquick PCR Purification Kit (Qiagen, Valencia, Calif.).

Overlapping fragments were linked together by overlapping PCR. The first overlapping PCR was assembled to include 50 µL AccuPrime Pfx SuperMix, 1 µL of 20 ng/µL $P_{gap}$ overlapping fragment, 2 µL of 10 ng/µL counterpart xylA overlapping fragment, and 1 µL of 10 µM forward and reverse primers as follows. Reaction was conducted by following a hot start PCR program with 30 cycles of denaturing at 95° C. for 30 sec/annealing at 55° C. for 30 sec/extension at 68° C. for 2 min. As a result, a $P_{gap}$-AMxylA fragment was synthesized from $P_{gap}$-AM and AMxylA fragments using primers ara98 and ara115 (SEQ ID NOs:314 and 321); a $P_{gap}$-ECxylA fragment was synthesized from $P_{gap}$-EC and ECxylA fragments using primers ara98 and ara117 (SEQ ID NOs:314 and 323); and a $P_{gap}$-LBxylA fragment was synthesized from $P_{gap}$-LB and LBxylA fragments using primers ara98 and ara119 (SEQ ID NOs:314 and 325).

These $P_{gap}$-xylA fragments were confirmed by running 5 µL of each PCR sample on an agarose gel, and then purified by using QIAquick PCR Purification Kit.

A second overlapping PCR was assembled similarly to above. It included 50 µL AccuPrime Pfx SuperMix, 1 µL of 20 ng/µL araD3'UTR overlapping fragment, 2 µL of 10 ng/µL $P_{gap}$-xylA fragment, 1 µL of 10 µM primer ara97 (SEQ ID NO:319), and 1 µL of 10 µM primer ara98 (SEQ ID NO:318). Reaction was carried out for 30 cycles of denaturing at 95° C. for 30 sec/annealing at 56° C. for 30 sec/extension at 68° C. for 2.5 min. Five microliters of the resulting PCR product were inspected on an agarose gel. The reactions containing $P_{gap}$-AMxylA and $P_{gap}$-LBxylA produced a 1,714-bp chimeric AMxylA operon fragment ($P_{gap}$-AMxylA-araD3'UTR) and a 1,879-bp chimeric LBxylA operon fragment ($P_{gap}$-LBxylA-araD3'UTR), respectively. In both chimeric gene fragments, the first 17 nucleotides provide StuI and SpeI sites while the last 35 nucleotides contain FesI, HindIII, and EcoI sites. The PCR reaction containing $P_{gap}$-ECxylA failed to generate the chimeric ECxylA fragment ($P_{gap}$-ECxylA-araD3'UTR).

The chimeric genes containing AMxylA and LBxylA were each ligated into a double crossover (DCO) vector named pARA354 (SEQ ID NO:313) that was described in commonly owned and co-pending U.S. patent application Ser. No. 12/796,025. pARA354 is pBS SK(+) derived plasmid (a Bluescript plasmid; Stratagene), used as a suicide vector since pBS vectors cannot replicate in *Zymomonas*, containing a $P_{gap}$-araBAD operon as described above and DCO homologous recombination fragments to direct integration of a bounded fragment into the IdhA locus of the *Zymomonas* genome. The two IdhA DNA fragments of pARA354 for DCO, LDH-L and LDH-R, were synthesized by PCR using *Z. mobilis* DNA as template. The reaction used AccuPrime Mix and followed a standard PCR procedure. The LDH-L DNA fragment was synthesized using forward primer ara20 (SEQ ID NO:326) and reverse primer ara21 (SEQ ID NO:327). The resulting product was an 895-bp DNA fragment including sequence 5' to the IdhA coding region and nucleotides 1-493 of the IdhA coding region, with a 5' SacI site and a 3' SpeI site (SEQ ID NO:328). The LDH-R DNA fragment was synthesized using forward primer ara22 (SEQ ID NO:329) and reverse primer ara23 (SEQ ID NO:330). The resulting product was a 1169 bp fragment including nucleotides 494-996 of the IdhA coding region and sequence 3' to the IdhA coding region, with a 5' EcoRI site and a 3' NotI site (SEQ ID NO:331). Since LDH-L and LDH-R contained the first 493 base pairs and the remaining 503 base pairs of the IdhA coding sequence, respectively, pARA354 was designed to direct insertion of a DNA fragment into the IdhA coding sequence of *Z. mobilis* between nucleotides #493 and #494 by crossover recombination pARA354 contains an f1(+) origin and an ampicillin resistance gene for plasmid propagation in *E. coli*. In addition, between the LDH-L and LDH-R homologous recombination fragments in pARA354 is the aadA marker (for spectinomycin resistance) bounded by wild type LoxP sites (LoxPw-aadA-LoxPw fragment; SEQ ID NO:307) and a $P_{gap}$-araBAD operon.

The PCR fragments containing AMxylA and LBxylA chimeric genes were each digested with SpeI and EcoRI, subjected to agarose gel electrophoresis, and purified by using QIAquick Gel Purification Kit (Qiagen). At the same time, pARA354 was also digested with SpeI and EcoRI to drop out the $P_{gap}$araBAD operon. The EcoRI-pARA354-SpeI plasmid backbone (6,023 bp) was isolated by agarose gel electrophoresis, and purified by using a QIAquick Gel Purification Kit. The chimeric AMxylA and LBxylA genes were each constructed into the pARA354 backbone in 15 µL standard ligation reactions that included 5 µL of the digested AMxylA or LBxylA chimeric gene fragment, 2 µL of the digested pARA354 backbone, 3 µL 5× ligase buffer, and 1 µL T4 DNA ligase (Invitrogen), resulting in a 7,714-bp DCO plasmid pARA355 and a 7,879-bp DCO plasmid pARA356, respectively. Both plasmids were propagated in DH5α *E. coli* cells and prepared by using QIAprep Spin Miniprep Kit (Qiagen).

To construct a chimeric ECxylA gene in the DCO vector, the $P_{gap}$-ECxylA overlapping fragment produced in the first overlapping PCR was digested with SpeI and XbaI, subjected to agarose gel electrophoresis, and purified by using QIAquick Gel Purification Kit. At the same time, pARA355 was digested with SpecI and XbaI. The XbaI-pARA355-SpeI plasmid backbone (6,220 bp) was isolated by agarose gel electrophoresis, and purified by using QIAquick Gel Purification Kit. The $P_{gap}$-ECxylA fragment was assembled into the pARA355 backbone in a 15 µL standard ligation reaction as described above, including 5 µL of the digested $P_{gap}$-ECxylA fragment and 2 µL of the digested pARA355 backbone fragment. The resultant 7,852 bp DCO plasmid pARA357 was propagated in DH5α *E. coli* cells and prepared by using QIAprep Spin Miniprep Kit.

Example 2

Integration of Chimeric AMxylA, LBxylA, and ECxylA Genes into *Zymomonas mobilis* Strain ZW641

Effects of expressing the *A. missourinesis*, *L. brevis* or *E. coli* XI in a xylose-utilizing *Zymomonas mobilis* were assayed using strain ZW641. Preparation of the ZW641 strain is described in Example 1 of U.S. Pat. No. 7,741,119, which is incorporated herein by reference. Strain X13L3 described therein was later renamed ZW641. ZW641 was prepared by sequentially integrating the two operons $P_{gap}$xylAB and $P_{gap}$-taltkt, along with the chloramphenicol resistance selectable marker, into the genome of *Zymomonas mobilis* ZW1 (ATCC #31821). Transformants were further adapted for xylose utilization by growth in xylose-containing medium.

In the ZW641 integrated $P_{gap}$xylAB and $P_{gap}$taltkt operons the xylA, xylB, tal, and tkt coding regions are from *E. coli* genes. Though ZW641 has all four genes necessary for xylose metabolism, xylose utilization is not optimal. Thus a background level of xylose utilization in ZW641 could potentially be improved by expressing an additional XI gene.

Competent cells of the ZW641-1A strain (a ZW641 isolate) were prepared by growing seed cells overnight in MRM3G5 (1% yeast extract, 15 mM $KH_2PO_4$, 4 mM $MgSO_4$, and 50 g/L glucose) at 30° C. with 150 rpm shaking, to an $OD_{600}$ value near 5. The $OD_{600}$ value was measured using a Shimadzu UV-1200 Spectrophotometer (Kyoto, Japan). Cells were harvested and resuspended in fresh medium to an $OD_{600}$ value of 0.05. The cells were grown under the same conditions to early to middle log phase ($OD_{600}$ near 0.5). Cells were harvested and washed twice with ice-cold water and then once with ice-cold 10% glycerol. The resulting competent cells were collected and resuspended in ice-cold 10% glycerol to an $OD_{600}$ value near 100. Since transformation of *Z. mobilis* requires non-methylated DNA, DCO plasmids pARA355, pARA356, and pARA357 were each transformed into *E. coli* SCS110 competent cells (Stratagene, La Jolla, Calif.). For each transformation, one colony of transformed cells was grown in 10 mL LB-Amp 100 (LB broth containing 100 mg/L ampicillin) overnight at 37° C. DNA was prepared from the 10 mL culture, using QIAprep Spin DNA Miniprep Kit (Qiagen).

Approximately 1 μg non-methylated plasmid DNA was mixed with 50 μL ZW641-1A competent cells in a 1 mM Electroporation Cuvette (VWR, West Chester, Pa.). The plasmid DNA was electroporated into the cells at 2.0 KV using a BT720 Transporater Plus (BTX-Genetronics, San Diego, Calif.). Transformed cells were recovered in 1 mL MMG5 medium (10 g/L glucose, 10 g/L yeast extract, 5 g/L tryptone, 2.5 g/L $(NH_4)_2SO_4$, 2 g/L $K_2HPO_4$, and 1 mM $MgSO_4$) for 4 hours at 30° C. and grown on MMG5-Spec250 plates (MMG5 with 250 mg/L spectinomycin and 15 g/L agar) for 3 days at 30° C., inside an anaerobic jar with an AnaeroPack (Mitsubishi Gas Chemical, New York, N.Y.). About 20 spectinomycin-resistant colonies were obtained for each transformation. These colonies were streaked onto a fresh MMG5-Spec250 plate and their growth under the same conditions as described above indicated that the chimeric xylA gene/Spec-R construct had been integrated into the genome of ZW641. Integration was analyzed by PCR. One reaction included 25 μL PCR SuperMix (Invitrogen), 0.5 μL 10 μM forward primer and reverse primer (as specified below), and a small amount of Z. moblis cells from the colonies. Reaction was carried out on an Eppendorf Mastercycler, following a hard start PCR program with 35 cycles of denaturing at 94° C. for 45 sec/annealing at 55° C. for 45 sec/extension at 72° C. for 1.5 min. Reactions were examined by running 5 μL on an agarose gel. When ara46 and ara43 primers (SEQ ID NOs: 332 and 333) were used in the first inspection, a 1,521-bp PCR product was amplified from most colonies. This product spans from the aadA coding region of the Spec-R marker in the plasmids to a Z. mobilis genomic sequence downstream of the LDH-R fragment, demonstrating the integration events mediated by the LDH-R fragment. When forward-reverse primer pairs were ara45-ara120 (SEQ ID NOs:334 and 315), ara45-ara122 (SEQ ID NOs:334 and 317), and ara45-ara121 (SEQ ID NOs:334 and 316) in the second inspection, a 1,289-bp PCR product was amplified from the colonies of ZW641-ara355, ZW641-ara356, and ZW641-ara357, respectively. These products span from a Z. mobilis genomic sequence upstream of the LDH-L fragment to AMxylA in pARA355, LBxylA in pARA356, or ECxylA in pARA357. These demonstrated the integration events mediated by the LDH-L fragment. Therefore, PCR evidence confirmed that the chimeric xylA operon/Spec-R construct had been integrated into the genome of ZW641-1A. The ZW641-1A cells transformed with pARA355, pARA356, and pARA357 were named as ZW641-ara355, ZW641-ara356, and ZW641-ara357, respectively.

Example 3

Characterization of AMxylA, LBxylA, and ECxylA Expression in *Zymomonas mobilis* Strain ZW641

ZW641 has a copy of the native *E. coli* xylA coding region, which is expressed at a low level. Strains ZW641-ara355, ZW641-ara356, and ZW641-ara357 each contain an additional copy of a codon-optimized xylA coding region: AMxylA, LBxylA, and ECxylA, respectively. Enhanced xylose utilization, ethanol production, and growth in xylose were assayed for the strains.

To examine the growth of these new strains in media containing xylose and compare them with the parent strain ZW641-1A, two strains (#1 and #2) of each of ZW641-ara355, ZW641-ara356, and ZW641-ara357 from the MMG5-Spec250 plates described in the previous example were re-streaked onto a MMx5 plate (the same medium except glucose is replaced by xylose). ZW641 was also streaked onto the plate as a control. Cells on the plate were grown for 6 days at 30° C. inside an anaerobic jar with an AnaeroPack. Growth was observed for all three sets of the new strains, but not for the ZW641 control. The #1 and #2 strains of ZW641-ara355, which contain an additional copy of AMxylA, showed significantly more growth on the xylose medium than ZW641-ara356 and ZW641-ara357 strains.

Figure 4:
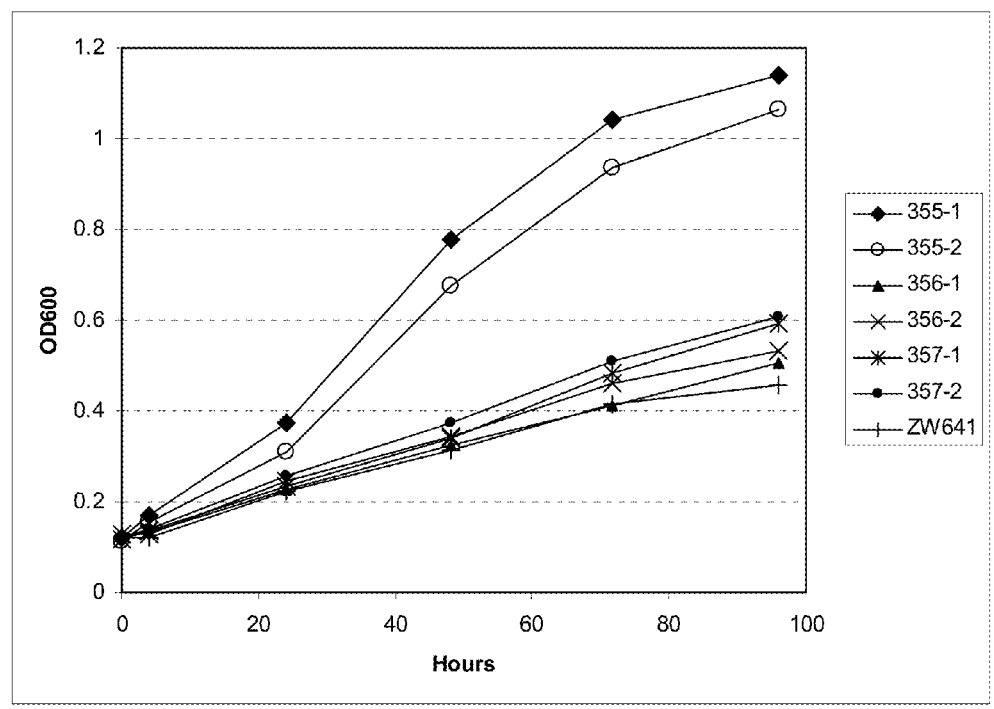
FIG. 4 is a graph of growth curves for a control ZW641 strain and strains of ZW641 transformed with a gene having a codon-optimized coding region for expression of xylose isomerase from *A. missourinesis* (355-1, 355-2), *L. brevis* (356-1, 356-2), or *E. coli* (357-1, 357-2).

To quantitatively measure the growth in xylose, these 7 strains were subjected to a 96-hour growth assay. In the assay, cells from each strain were grown overnight in 3 mL MRM3G5 in a 30° C. 150 rpm shaker. Cells were harvested, washed with MRM3×10 (same as MRM3G5 but 50 g/L glucose was replaced by 100 g/L xylose), and resuspended in MRM3×10 to have a starting $OD_{600}$ value near 0.1. Twenty-five milliliters of the suspension was placed in a 50 mL screw capped VWR centrifuge tube and grown at 30° C. with 150 rpm shaking for a 96-hour time course. During the time course, $OD_{600}$ value was measured at 0-, 4-, 24-, 48-, 72-, and 96-hours. The results plotted as growth curves in FIG. 4 show that the second copy of xylA indeed enhanced the growth of the engineered strains in xylose containing medium. When comparing between those strains containing the second copy of xylA, ZW641-ara355 grew significantly faster than ZW641-ara357. It had a cell density almost twice as high as ZW641-ara357 after 96 hours of growth. This result indicates that the xylose isomerase encoded by AMxylA may function much better than the xylose isomerase encoded by ECxylA. ZW641-ara356 grew similarly to or slightly slower than ZW641-ara357, indicating that the xylose isomerase encoded by LBxylA may not function better than the xylose isomerase encoded by ECxylA.

During the time course, 1 mL samples of the ZW641, ZW641-ara355-1, ZW641-ara356-2, and ZW641-ara357-2 cultures were collected at the 72-hour point. They were centrifuged at 10,000×g to remove cells. The supernatant was filtered through a 0.22 μm Costar Spin-X Centrifuge Tube Filter and analyzed by running through a BioRad Aminex HPX-A7H ion exclusion column with 0.01 N $H_2SO_4$ in a speed of 0.6 mL/min at 55° C. on an Agilent 1100 HPLC system to determine ethanol and xylose concentrations. The results given in Table 5 show that, comparing to the basal level xylose utilization and ethanol production in ZW641, AMxylA in ZW641-ara355 significantly promoted xylose consumption and had increased ethanol production by more than 3.5 fold. ECxylA in ZW641-ara357 slightly increased xylose metabolism and ethanol production, while LBxylA in ZW641-ara356 offered the smallest increase in xylose utilization and did not cause a detectable change in ethanol production. These results agree with previous observations on the growth and suggest that the difference in growth between the strains was caused by the difference in xylose metabolism, which may result from a difference in xylose isomerase activity.

TABLE 5

Cell growth, xylose consumption, and ethanol production after 72 hours culturing at 30° C. in MRM3X10.

| Strain | Additional XI source | Growth ($OD_{600}$) | Ethanol (g/L) | Xylose* (g/L) |
|---|---|---|---|---|
| ZW641 | none | 0.46 | 1.9 | 93.1 |
| ZW641-ara355-1 | A. missourinesis | 1.14 | 6.8 | 81.7 |
| ZW641-ara356-2 | L. brevis | 0.53 | 1.9 | 92.9 |

TABLE 5-continued

Cell growth, xylose consumption, and ethanol production after 72 hours culturing at 30° C. in MRM3X10.

| Strain | Additional XI source | Growth (OD$_{600}$) | Ethanol (g/L) | Xylose* (g/L) |
|---|---|---|---|---|
| ZW641-ara357-2 | E. coli | 0.61 | 2.2 | 91.7 |
| MRM3X10+ | na# | na | 0.0 | 95.8 |

*xylose remaining in the medium
+starting media
na: not applicable

Figure 5:
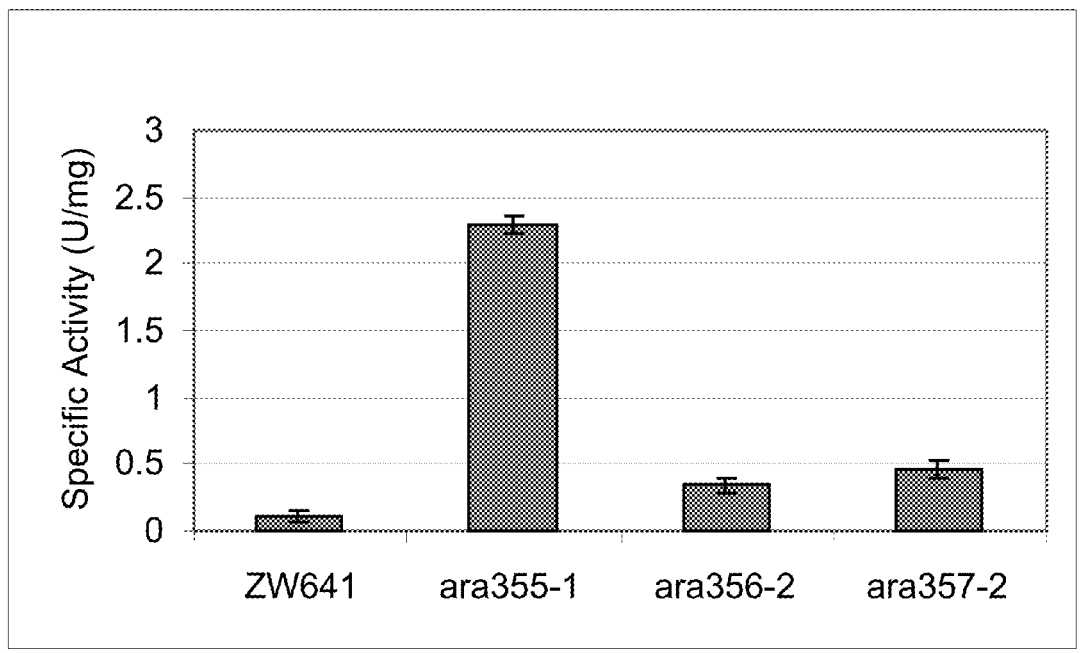
FIG. 5 is a graph of xylose isomerase activities in a control ZW641 strain and strains of ZW641 transformed with a gene having a codon-optimized coding region for expression of xylose isomerase from *A. missourinesis* (355-1), *L. brevis* (356-2), or *E. coli* (357-2) measured by the Cysteine-Carboazole method.

To determine whether xylose isomerase enzymes encoded by AMxylA, LBxylA, and ECxylA have different activities, ZW641, ZW641-ara355-1, ZW641-ara356-2, and ZW641-ara357-2 were grown overnight in MRM3G5 on a 30° C. 150 rpm shaker. Cells were collected from 2 mL cultures by 10,000×g centrifugation, washed with ice-cold Protein Extraction Buffer (10 mM triethanolamine hydrochloride, pH8.0, 10 mM MgSO$_4$, 1 mM DTT, and 5% glycerol), resuspended in 500 µL ice-cold Protein Extraction Buffer, and subjected to 3 minutes sonication for 3 times at setting 7 by using a Misonix Sonicator 4000 with microplate horn (Qsonica, Newtown, Conn.). Cell debris was removed by 10,000× g centrifugation. Supernatants were kept as protein extracts. Their protein concentrations were measured by using Coomassie Plus Protein Assay Reagent (Pierce, Rockford, Ill.), and xylose isomerase activities were measured by a modified Cysteine-Carboazole method. A 100 µL Cysteine-Carboazole assay reaction contained 10 mM triethanolamine hydrochloride buffer, pH7.0, 10 mM MgSO$_4$, 25 mM D-xylose, and 30 µg extracted protein. After incubation at 32° C. for 15 minutes, the reaction was stopped by adding 25 µl 50% trichloroacetic acid. Then, 3 ml ice-cold 75% sulphuric acid, 100 µl 2.4% cysteine hydrochloride solution, and 100 µl 0.12% carbazole ethanolic solution were sequentially added into the reaction. The mixture was kept at room temperature for 10 minutes. OD$_{540}$ value was measured on a Shimadzu UV-1200 Spectrophotometer. The corresponding D-xylulose concentration was determined based on a standard curve of D-xylulose concentration vs. OD$_{540}$ value. The standard curve was developed by carrying out Cysteine-Carboazole assays containing various amounts of D-xylulose but no D-xylose and protein. Finally, one unit of xylose isomerase enzyme was defined as the activity required to produce one micromole of D-xylulose in the reaction. Specific activity was calculated as unit per milligram of protein. In the assay, background OD$_{540}$ of D-xylose was measured in a blank reaction without protein. This background was subtracted from the original OD$_{540}$ reading prior to calculation of activity. Each assay was repeated 3 times. The results of the Cysteine-Carboazole assay are graphed in FIG. 5 showing specific activities of xylose isomerase in the protein extracts of ZW641, ZW641-ara355-1, ZW641-ara356-2, and ZW641-ara357-2. Each activity bar represents an average of three parallel reactions with a standard deviation calculated based on them. This result demonstrates that expression of the second copy of xylA in ZW641 introduced additional xylose isomerase activity into cells. AMxylA in ZW641-ara355, LBxylA in ZW641-ara356, and ECxylA in ZW641-ara357 increased XI activity by approximately 20-fold, 3 fold, and 4 fold, respectively. Since these three xylA genes are constructed in ZW641 by the same approach, the difference in the xylose isomerase specific activities in the cell extracts suggests that the xylose isomerase from A. missouriensis functions much better than xylose isomerases from L. brevis and E. coli. In fact, the A. missouriensis XI presented a specific activity of about 2.3, which was 6 times higher than L. brevis XI and 5 times higher than E. coli XI. Therefore, by examining cell growth, xylose metabolism, and XI activity, this example has identified A. missouriensis XI as an excellent xylose isomerase for improving xylose utilization in xylose-utilizing Z. mobilis strains.

Example 4

Structural Analysis of Xylose Isomerase Enzymes

A collection of available protein sequences that are potentially xylose isomerases was prepared by first identifying a set of seed sequences that are known to have xylose isomerase (XI) activity. The seed sequences were retrieved as xylose isomerases from the SWISSPROT database, which contains protein sequences that have high confidence functional annotations. There were 180 XI seed sequences retrieved from SWISSPROT (Swiss Institute of Bioinformatics): SEQ ID NOs:2, 24, 32, 34, 42, 54, 66, 68, 78, 96, 100, 106, 108, 122, 126, 128, 130, 132, 135, 137, 142 and 148-306. These seed sequences were then used to search the NCBI (National Center for Biotechnology Information, Bethesda, Md.) non-redundant (nr) comprehensive protein database as a group of multiple query sequences in the blastall wrapper of BLAST. A total of 444 sequences were identified to form a set that can be described as the sequence space of XI activity proteins.

Clustering based on sequence identity and molecular phylogenetic analysis using the PHYLIP neighbor joining algorithm (as implemented in PHYLIP (Phylogeny Inference Package) version 3.5c (Felsenstein (1989) Cladistics 5:164-166) showed that the above generated sequence space for XI activity separated into two groups referred to as Group I and Group II as shown in FIG. 2. The Group I set consisted of 82 sequences (SEQ ID NOs that are even numbers between 2 and 130 and 131-147), 21 of which were seeds (SEQ ID NOs:2, 24, 32, 34, 42, 54, 66, 68, 78, 96, 100, 106, 108, 122, 126, 128, 130, 132, 135, 137, and 142). Similarly, the Group II set consisted of 351 members, 159 of which were seeds (SEQ ID NOs:148-306). As shown in FIG. 2, the L. brevis and E. coli XI proteins belong to Group II while the A. missouriensis XI protein belongs to Group I.

The following process was followed in forming the phylogenetic groups:
Starting with the 444 XI sequences:
Step 1 establishing 70% identity groups:
The longest sequence out of the 444 sequences was designated as the first master. Other sequences of the 444 sequences that have 70% or more sequence identity to the first master were grouped to form the first ref70 cluster (A). Out of the remaining sequences, the longest sequence was designated the second master and used create the second ref70 cluster similarly (B). The grouping process was continued until every sequence was in a cluster. Some of the clusters were singletons.
Step 2 merging at 70% threshold:
For every pair of clusters A and B, if a third of the sequences in A are related to sequences in B by 70% sequence identity or more and vice-versa, clusters A and B were merged. This process was continued until there were no pairs that could be merged using the 70% identity threshold.
Step 3 merging at 50% threshold:
The same process as in step 2 was followed but using a sequence identity threshold of 50%.

Step 4 merging at 30% threshold:

The same process as in step 2 was followed but using a sequence identity threshold of 30%.

Group I represents a 50% threshold identity cluster. Group II represents a separate 50% threshold identity cluster.

There were 11 sequences that were not unambiguously assigned to Group I or Group II since they did not cluster with either group at the 50% threshold of identity.

FIG. 3 shows a phylogenetic tree for the Group I XIs with specific genera labeled. Group I includes XI proteins from *Arthrobacter, Streptomyces, Thermus, Thermobaculum, Herpetosiphon, Acidobacteria, Roseiflexus, Meiothermus, Deinococcus, Meiothermus, Stackebrandtia, Kribbella, Xylanimonas, Nocardiopsis, Catenulispora, Streptosporangium, Geodermatopyilus, Actinosynnema, Saccharomonospora, Acicothermus, Tthermobifida, Nocardiodes, janibacter, Mycobacterium, Leifsonia, Clavibacter, Micromonospora, Salinispora, Cellulomonas, jonesia, Nakamurella, Actinomyces, Mobiluncus, Brachybacterium, Beutengergai, Frankia,* and *Actinobacterium*.

Discriminating Between Group I and Group II: Method 1

Discrimination between Group I members and Group II members was performed by GroupSim analysis (Capra and Singh (2008) Bioinformatics 24: 1473-1480). The GroupSim method identifies amino acid residues that determine a protein's functional specificity. In a multiple sequence alignment (MSA) of a protein family whose sequences are divided into multiple groups, amino acid residues that distinguish between the functional groups of sequences can be identified. The method takes a multiple sequence alignment (MSA) and known specificity groupings as input, and assigns a score to each amino acid position in the MSA. Higher scores indicate a greater likelihood that an amino acid position is a specificity determining position (SDP).

GroupSim analysis performed on the MSA of XI sequences that were divided into Group I and Group II by the phylogenetic analysis above identified highly discriminating positions. Listed in Table 6 are positions (Pos) having scores greater than or equal to 0.9, where a perfect score of 1.0 would indicate that all proteins within the group have the listed amino acid in the specified position and between groups the amino acid would always be different. The "residue" column gives the amino acid(s) in single letter code for the position in Group I proteins vs in Group II proteins (separated by a bar: I). The amino acid position number in column 2 is for the representative Group I protein P12581 which is the XI from *Actinoplanes missourinesis*. The amino acid position number in column 3 is for the representative Group II protein P19148 which is the XI *Thermoanaerobacterium thermosulfurigenes* (SEQ ID NO:267)

TABLE 6

Highly discriminating amino acid positions for Group I and Group II XIs from GroupSim analysis.

| Pos in alignment | Pos in P12851 (member of Group I) | Pos in P19148 (member of Group II) | Residue (Group I\|Group II) |
|---|---|---|---|
| 391 | 226 | 277 | L\|H |
| 388 | 223 | 274 | M\|L |
| 341 | 191 | 242 | I\|Q |
| 345 | 195 | 246 | TSV\|D |
| 228 | 88 | 139 | MTG\|RW |
| 462 | 290 | 337 | H\|NM |
| 386 | 221 | 272 | ED\|ATG |
| 407 | 242 | 293 | FVL\|GCW |
| 408 | 243 | 294 | H\|SNGL |

TABLE 6-continued

Highly discriminating amino acid positions for Group I and Group II XIs from GroupSim analysis.

| Pos in alignment | Pos in P12851 (member of Group I) | Pos in P19148 (member of Group II) | Residue (Group I\|Group II) |
|---|---|---|---|
| 343 | 193 | 244 | LFM\|D |
| 422 | 256 | 308 | Q\|TIVLMYH |
| 377 | 213 | 264 | G\|KNSEALRQ |
| 460 | 288 | 335 | PYAS\|VG |
| 415 | 249 | 301 | Q\|DHNRSA |

Discriminating Between Group I and Group II: Method 2

An alternative structure/function characterization of the groups of the xylose isomerase family of enzymes was performed using the HMMER software package (the theory behind profile HMMs is described in R. Durbin, S. Eddy, A. Krogh, and G. Mitchison, *Biological sequence analysis: probabilistic models of proteins and nucleic acids*, Cambridge University Press, 1998; Krogh et al., 1994; J. Mol. Biol. 235:1501-1531), following the user guide which is available from HMMER (Janelia Farm Research Campus, Ashburn, Va.).

Using a multiple sequence alignment of the 21 seed sequences in Group I (SEQ ID NOs:2, 24, 32, 34, 42, 54, 66, 68, 78, 96, 100, 106, 108, 122, 126, 128, 130, 132, 135, 137, and 142), a profile Hidden Markov Model (HMM) was created for representing Group I members. As stated in the user guide, Profile HMMs are statistical models of multiple sequence alignments. They capture position-specific information about how conserved each column of the alignment is, and which amino acid residues are most likely to occur at each position. Thus HMMs have a formal probabilistic basis. Profile HMMs for a large number of protein families are publicly available in the PFAM database (Janelia Farm Research Campus, Ashburn, Va.).

The Profile HMM was built as follows:

Step 1. Build a Sequence Alignment

The 21 seed sequences (sequences with high confidence annotation) that are in Group I were aligned using Clustal W with default parameters.

Step 2. Build a Profile HMM

The hmmbuild program was run on the set of aligned sequences using default parameters. hmmbuild reads the multiple sequence alignment file, builds a new Profile HMM, and saves the Profile HMM to file. Using this program an uncalibrated profile was generated from the multiple alignment for the set of seed sequences described above.

The following information based on the HMMER software user guide gives some description of the way that the hmmbuild program prepares a Profile HMM. A Profile HMM is capable of modeling gapped alignments, e.g. including insertions and deletions, which lets the software describe a complete conserved domain (rather than just a small ungapped motif). Insertions and deletions are modeled using insertion (I) states and deletion (D) states. All columns that contain more than a certain fraction x of gap characters will be assigned as an insert column. By default, x is set to 0.5. Each match state has an I and a D state associated with it. HMMER calls a group of three states (M/D/I) at the same consensus position in the alignment a "node". These states are interconnected with arrows called state transition probabilities. M and I states are emitters, while D states are silent. The transitions are arranged so that at each node, either the M state is used (and a residue is aligned and scored) or the D state is used (and no residue is aligned, resulting in a deletion-gap character, '-'). Insertions occur between nodes, and I states have a self-transition, allowing one or more inserted residues to occur between consensus columns.

The scores of residues in a match state (i.e. match state emission scores), or in an insert state (i.e. insert state emission scores) are proportional to Log_2 (p_x)/(null_x). Where p_x is the probability of an amino acid residue, at a particular position in the alignment, according to the Profile HMM and null_x is the probability according to the Null model. The Null model is a simple one state probabilistic model with pre-calculated set of emission probabilities for each of the 20 amino acids derived from the distribution of amino acids in the SWISSPROT release 24.

State transition scores are also calculated as log odds parameters and are propotional to Log_2 (t_x). Where t_x is the probability of transiting to an emitter or non-emitter state.

Step 3. Calibrate the Profile HMM

The Profile HMM was read using hmmcalibrate which scores a large number of synthesized random sequences with the Profile (the default number of synthetic sequences used is 5,000), fits an extreme value distribution (EVD) to the histogram of those scores, and re-saves the HMM file now including the EVD parameters. These EVD parameters (μ and λ) are used to calculate the E-values of bit scores when the profile is searched against a protein sequence database. hmmcalibrate writes two parameters into the HMM file on a line labeled "EVD": these parameters are the μ (location) and λ (scale) parameters of an extreme value distribution (EVD) that best fits a histogram of scores calculated on randomly generated sequences of about the same length and residue composition as SWISS-PROT. This calibration was done once for the Profile HMM.

The calibrated profile HMM for the Group I set is provided as Table 1 in the appendix as a Group I profile HMM Excel chart. The Profile HMM is provided in a chart that gives the probability of each amino acid occurring at each position in the amino acid sequence. The highest probability is highlighted for each position. Table 7 shows a few lines of the Group I Profile HMM.

(highest score is highlighted). The second line reports the insert emission scores, and the third line reports on state transition scores: M→M, M→I, M→D; I→M, I→I; D→M, D→D; B→M; M→E. Table 7 shows that in the Group I profile HMM, methionine has a 4620 probability of being in the first position, the highest probability.

Step 4. Test the Specificity and Sensitivity of the Built Profile HMM

The Group I profile HMM was evaluated using hmmsearch, with the Z parameter set to 1 billion, for the ability to discriminate Group I members from those of Group II. The hmmsearch program takes the hmm file for the Group I profile HMM and all the sequences from both groups and assigns an E-value score to each sequence. This E-value score is a measure of fit to the Profile HMM, with a lower score being a better fit. The resulting score assignment list is provided in the appendix as Table 2. The Profile HMM clearly distinguished Group I members from Group II members since there was a large margin of E-value difference between the worst scoring Group I member (2.2e-181) and the best scoring Group II member (1.5e-07).

This analysis shows that the Profile HMM prepared for Group I XI proteins distinguishes Group I from Group II XI proteins. The Group I Profile HMM provides a structure that is linked to XI proteins that are functionally similar to XI of *A. missouriensis*.

Example 5

Construction of Chimeric $P_{gapS}$-xylA Genes for Group 1 XIs and Assembly of Double Crossover Suicide Vectors The xylose isomerases from Geodermatophilus obscurus DSM 43160 (GOxylA; SEQ ID NO:64), *Mycobacterium smegmatis* str. MC2 155 (MSxylA; SEQ ID NO:10), Salinispora arenicola CNS-205 (SAxylA; SEQ ID NO:18), and

TABLE 7

A portion of the Group I Profile HMM.

| HMM | A | C | D | E | F | G | H | I | K | L | M |
|---|---|---|---|---|---|---|---|---|---|---|---|
|  | m->m | m->i | m->d | i->m | i->i | d->m | d->d | b->m | m->e |  |  |
|  | -462 | * | -1868 |  |  |  |  |  |  |  |  |
| 1 | -1476 | -1441 | -2702 | -2503 | -679 | -2424 | -1861 | -88 | -2024 | 240 | 4620 |
| — | -149 | -500 | 233 | 43 | -381 | 399 | 106 | -626 | 210 | -466 | -720 |
| — | -24 | -6482 | -7525 | -894 | -1115 | -701 | -1378 | -462 | * |  |  |
| 2 | 421 | -976 | -556 | -40 | -1303 | -1252 | -182 | -920 | 65 | -1119 | 1573 |
| — | -149 | -500 | 233 | 43 | -381 | 399 | 106 | -626 | 210 | -466 | -720 |
| — | -21 | -6672 | -7714 | -894 | -1115 | -701 | -1378 | * | * |  |  |
| 3 | -926 | -719 | -2839 | -2316 | 1366 | -2394 | -664 | 122 | -1975 | 1177 | 430 |
| — | -149 | -500 | -233 | 43 | -381 | 399 | 106 | -626 | 210 | -466 | -720 |
| — | -21 | -6672 | -7714 | -894 | -1115 | -701 | -1378 | * | * |  |  |

| HMM | N | P | Q | R | S | T | V | W | Y |
|---|---|---|---|---|---|---|---|---|---|
| 1 | -2293 | -2670 | -1975 | -1997 | -1977 | -1568 | -381 | -1705 | -1336 |
| — | 275 | 394 | 45 | 96 | 359 | 117 | -369 | -294 | -249 |
| 2 | 1057 | -1439 | 138 | -354 | 1386 | 371 | -651 | -1514 | -1000 |
| — | 275 | 394 | 45 | 96 | 359 | 117 | -369 | -294 | -249 |
| 3 | -1816 | -2377 | -1532 | -1832 | -1492 | -859 | 972 | -254 | 2848 |
| — | 275 | 394 | 45 | 96 | 359 | 117 | -369 | -294 | -249 |

The amino acids are represented by the one letter code.

The first line for each position reports the match emission scores: probability for each amino acid to be in that state

*Xylanimonas cellulosilytica* DSM 15894 (XCxylA; SEQ ID NO:40) all belong to Group 1 xylose isomerases, based on amino acid sequence analysis described in Example 4. The sequences encoding these proteins were each optimized (SEQ ID NOs:335, 336, 337, and 338, respectively) for expression in Z. mobilis according to codon bias of Z. mobilis ZM4, and synthesized de novo as DNA fragments bounded by SpeI and XhoI sites, and with the coding region adjacent to a mutant Z. mobilis glyceraldehyde-3-phosphate dehydrogenase gene promoter ($P_{gapS}$; SEQ ID NO:339) by GenScript Corporation (Piscataway, N.J.). The $P_{gapS}$ is an improved $P_{gap}$ that has a mutation which is a "G" to "T" change at position 116 of the natural promoter fragment ($P_{gap}$), that increases expression from the promoter, as disclosed in US 2009-0246876. The SpeI-$P_{gapS}$-xylA-XhoI fragments were cloned into pUC57 at the EcoRV site by GenScript Corporation (Piscataway, N.J.). The resultant intermediate plasmids were called pUC57-$P_{gapS}$GOxylA, pUC57-$P_{gapS}$MSxylA, pUC57-$P_{gapS}$SAxylA, and pUC57-$P_{gapS}$XCxylA. The optimized xylA coding sequences are GOxylA (SEQ ID NO:335), MSxylA (SEQ ID NO:336), SAxylA (SEQ ID NO:337), and XCxylA (SEQ ID NO:338).

Common molecular cloning methods were used to construct DCO suicide vectors. First, plasmid pARA356 (described in Example 1) was modified to add an XhoI site between the LBxylA and araD3'UTR sequences as follows. First, an araD3'UTR fragment was PCR amplified from pARA356 using forward primer ara368 (SEQ ID NO:345) and reverse primer ara97 (SEQ ID NO:319). The ara368 primer added SpeI and XhoI sites to the 5' end of araD3'UTR, and ara97 added HindIII, FseI, and EcoRI sites to the 3' end of araD3'UTR. The PCR product was digested with SpeI and EcoRI. The Pgap-LBxylA-araD3'UTR segment in pARA356 has a 5' SpeI site and a 3' EcoRI site. This segment was removed by digestion with SpeI and EcoRI and it was replaced by the above SpeI-XhoI-araD3'UTR-HindIII-FseI-HindIII-EcoRI PCR product. The resulting intermediate plasmid pARA356D has same sequence as pARA356, except $P_{gap}$-LBxylA was replaced by a XhoI site.

The four $P_{gapS}$-xylA fragments described above were isolated from the pUC57-based plasmids following SpeI and XhoI digestion, and cloned into the XhoI-modified pARA356D between the SpeI and XhoI sites to replace the $P_{gap}$-LBxylA fragment. The resulting four DCO suicide vectors were pARA356-GOxylA, pARA356-MSxylA, pARA356-SAxylA, and pARA356-XCxylA. These vectors are identical to pARA356 except that their chimeric xylA genes are expressed from $P_{gapS}$.

As controls, AMxylA in pARA355 and ECxylA in pARA357 were used as representatives for Group I and II xylAs, respectively. However, since $P_{gapS}$ was employed to express the four new Group 1 xylA genes, the $P_{gap}$ promoters controlling AMxylA in pARA355 and ECxylA in pARA357 were changed to $P_{gapS}$. For this purpose, a 319-bp $P_{gapS}$ OLE-PCR fragment was synthesized from pARA356-XCxylA by PCR, using forward primer ara10 (SEQ ID NO:340) and reverse primer ara401 (SEQ ID NO:341); a 1,229-bp $P_{gapS}$-AMxylA OLE-PCR fragment was synthesized from pARA355 by PCR, using forward primer ara402 (SEQ ID NO:342) and reverse primer ara403 (SEQ ID NO:343); and a 1,367-bp $P_{gapS}$-ECxylA OLE-PCR fragment was synthesized from pARA357 by PCR, using forward primer ara402 and reverse primer ara404 (SEQ ID NO:344). One PCR reaction consisted of 50 µL AccuPrime Pfx SuperMix (Invitrogen, Carlsbad, Calif.), 1 µL of 40 ng/µL DNA template, and 1 µL of 10 µM forward and reverse primers. Reactions were carried out on an Eppendorf Mastercycler (Hemburg, Germany), following a hot start PCR program with 35 cycles of denaturing at 94° C. for 1 min/annealing at 56° C. for 1 min/extension at 72° C. for 2 min. The $P_{gapS}$ OLE-PCR fragment included the entire $P_{gapS}$, a 5' SpeI site, and a 3' start codon. The $P_{gapS}$-AMxylA and $P_{gapS}$-ECxylA OLE-PCR fragments contained an AMxylA and an ECxylA coding sequence, respectively. Each had a 36-nt 5' sequence that matches the last 36 nt of $P_{gapS}$ and a 3' XhoI site. Furthermore, SpeI-$P_{gapS}$-AMxylA-XhoI and SpeI-$P_{gapS}$-ECxylA-XhoI fragments were synthesized by overlapping PCR (OLE-PCR). PCR reactions were set up as described above, but two templates were included. SpeI-$P_{gapS}$-AMxylA-XhoI was amplified from $P_{gapS}$ and $P_{gapS}$-AMxylA OLE-PCR fragments by using forward primer ara10 and reverse primer ara403, while SpeI-$P_{gapS}$-ECxylA-XhoI was amplified from $P_{gapS}$ and $P_{gapS}$-ECxylA OLE-PCR fragments by using forward primer ara10 and reverse primer ara404. Both SpeI-$P_{gapS}$-AMxylA-XhoI and SpeI-$P_{gapS}$-ECxylA-XI were digested with SpeI and XhoI, subjected to agarose gel electrophoresis, and purified by using QIAquick Gel Purification Kit (Qiagen). The DNA fragments were cloned into modified pARA356 (described above) between SpeI and XhoI sites to replace the $P_{gap}$-LBxylA fragment. The resulting two DCO suicide vectors were called pARA356-AMxylA and pARA356-ECxylA. All vectors were propagated in DH5α E. coli cells and prepared by using a QIAprep Spin Miniprep Kit.

Example 6

Integration of Chimeric $P_{gapS}$-xylA Genes into ZW641 and Characterization of Their Expression This Example describes integration and expression of $P_{gapS}$-xylA chimeric genes in strain ZW641, described in Example 2, and demonstrates that the four tested Group I XIs indeed function better than Group II XIs in Z. mobilis.

Competent cells of strain ZW641-1A were prepared and transformed separately with pARA356-AMxylA, pARA356-ECxylA, pARA356-GOxylA, pARA356-MSxylA, pARA356-SAxylA, or pARA356-XCxylA. Transformants were selected on MMG5-Spec250 plates and analyzed by PCR for integration of the introduced $P_{gapS}$-xylA genes as described previously (see Example 2). The resultant strains were named ZW641-ara356-AMxylA, ZW641-ara356-ECxylA, ZW641-ara356-GOxylA, ZW641-ara356-MSxylA, ZW641-ara356-ASxylA, and ZW641-ara356-XCxylA strains. Among these strains, ZW641-ara356-AMxylA and ZW641-ara356-ECxylA were made as control strains since Example 3 demonstrated that the AMxylA Group 1 xylose isomerase was highly active in Z. mobilis, while ECxylA was the better enzyme of two tested Group II xylose isomerases.

Figure 6:
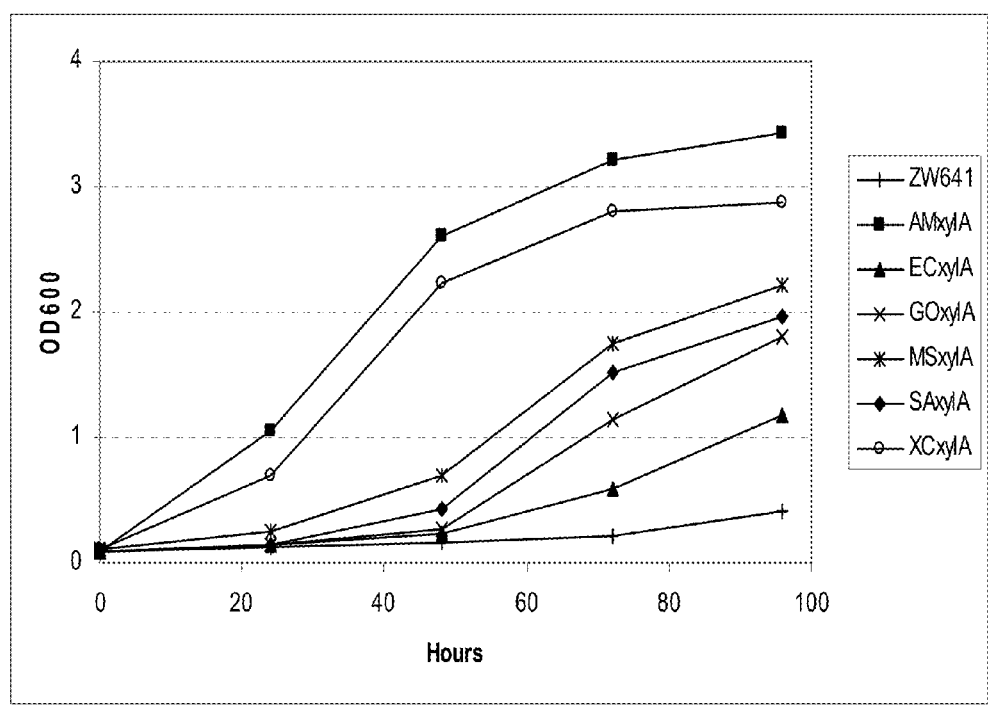
FIG. 6 is a graph of growth curves for a control ZW641 strain and strains of ZW641 transformed with a gene having a codon-optimized coding region for expression of xylose isomerase from *A. missourinesis* (AMxylA), *E. coli* (ECxylA), *Geodermatophilus obscurus* (GOxylA), *Mycobacterium smegmatis* (MSxylA), *Salinispora arenicola* (SAxylA), or *Xylanimonas cellulosilytica* (XCxylA).

To examine the growth of these six new strains in xylose and compare them with the parental strain ZW641-1A, all strains were subjected to a 96-hour shake flask fermentation in xylose. In the assay, each strain was grown overnight in 3 mL MRM3G5 at 30° C. with 150 rpm shaking. Cells were harvested, washed with MRM3×10 (same as MRM3G5 but 50 g/L glucose was replaced with 100 g/L xylose), and resuspended in MRM3×10 to $OD_{600}$ of about 0.1. Twenty-five milliliters of the suspension were placed in a 50 mL screw capped VWR centrifuge tube and grown at 30° C. with 150 rpm shaking for a 96-hour time course. During the time course, $OD_{600}$ was measured at 0, 24, 48, 72, and 96 hours. The resulting growth curve is shown in FIG. 6. It shows that similar to ZW1-ara355 and ZW1-ara357 strains analyzed in Example 3, ZW641-ara356-AMxylA grew to a cell density approximately three times higher than ZW641-ara356-ECxylA at end of the fermentation. ZW641-ara356-AMxylA had an $OD_{600}$ of 3.43, while ZW641-ara356-ECxylA reached 1.18. Both strains grew faster than ZW641. The other four strains all grew faster than ZW641-ara356-ECxylA. Their cell densities at end of the fermentation were between those of ZW641-ara356-AMxylA and ZW641-ara356-ECxylA.

To measure the metabolic profile of each strain, a 1 mL sample of each culture was collected at the 72-hour point. The samples were centrifuged at 10,000× g to remove cells. The supernatant was filtered through a 0.22 μm Costar Spin-X Centrifuge Tube Filter and analyzed by running through a BioRad Aminex HPX-A7H ion exclusion column with 0.01 $NH_2SO_4$ at a speed of 0.6 mL/min at 55° C. on an Agilent 1100 HPLC system to determine ethanol and xylose concentrations. The results given in Table 8 show that faster growth correlated with higher xylose utilization and more ethanol production. These results suggest that the difference in growth is due to the difference in XI activity. All strains had better growth, ethanol production and xylose utilization than the ZW641 control, and all strains with Group 1 XIs performed better than the strain with the Group II *E. coli* XI.

TABLE 8

Cell growth, xylose consumption, and ethanol production after 72 hours culturing at 30° C. in MRM3X10.

| Strain | Growth ($OD_{600}$) | Ethanol (g/L) | Xylose* (g/L) |
|---|---|---|---|
| ZW641 | 0.22 | 0.0 | 96.1 |
| ZW641-ara356-AMxylA | 3.21 | 26.3 | 41.5 |
| ZW641-ara356-ECxylA | 0.59 | 1.6 | 92.9 |
| ZW641-ara356-GOxylA | 1.14 | 3.0 | 90.0 |
| ZW641-ara356-MSxylA | 1.75 | 8.4 | 78.6 |
| ZW641-ara356-SAxylA | 1.51 | 5.0 | 86.3 |
| ZW641-ara356-XCxylA | 2.80 | 19.4 | 56.1 |
| MRM3X10[+] | na[#] | 0.0 | 96.1 |

*xylose remaining in the medium
[+]starting medium
[#]na: not applicable

To further confirm that these six strains each had an XI activity level corresponding to their growth and metabolic profiles, protein extracts were prepared as assayed for protein concentration and xylose isomerase activity as in Example 3. Specific activity was calculated as unit per milligram of protein with background $OD_{540}$ of D-xylose subtracted from the original $OD_{540}$ reading prior to calculation of activity. Each assay was repeated 3 times. FIG. 7 shows the resulting average specific XI activities in each protein extract. The absolute specific activities are lower than those in Example 3, most likely due to different reaction conditions. However, comparison of relative specific activities clearly shows that the XI activities correspond to the growth rates of the strains. Faster growth is supported by higher XI activity, with the AMxylA having highest activity and ECsyIA the lowest activity. All of the Group I XIs have higher average activities than the Group II ECxylA.

TABLE 1

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | -462 | * | -1868 | | | | | | | | | | | | | | | | | | |
| 1(M) | -1476 | -1441 | -2702 | -2503 | -679 | -2424 | -1861 | -88 | -2024 | 240 | ▓ | -2293 | -2670 | -1975 | -1997 | -1977 | -1568 | -381 | -1705 | -1336 | 1 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -24 | -6482 | -7525 | -894 | -1115 | -701 | -1378 | -462 | * | | | | | | | | | | | | |
| 2(M) | 421 | -976 | -556 | -40 | -1303 | -1252 | -182 | -920 | 65 | -1119 | ▓ | 1057 | -1439 | 138 | -354 | 1386 | 371 | -651 | -1514 | -1000 | 2 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | | -1115 | -701 | -1378 | * | | | | | | | | | | | | | |
| 3(Y) | -926 | -719 | -2839 | -2316 | 1366 | -2394 | -664 | 122 | -1975 | 1177 | 430 | -1816 | -2377 | -1532 | -1832 | -1492 | -859 | 972 | -254 | ▓ | 3 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 4(Q) | -587 | -1894 | 98 | 1129 | -2216 | -1318 | -135 | -1916 | 288 | -1916 | -1086 | 6 | -1535 | ▓ | -133 | -466 | 476 | -1535 | -2124 | -1485 | 4 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 5(P) | 963 | -839 | -1538 | -1576 | -2513 | -1059 | -1614 | -2104 | -1628 | -2420 | -1708 | -1177 | ▓ | -1478 | -1771 | -442 | -597 | -1456 | -2726 | -2418 | 5 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 6(T) | -582 | -1338 | -802 | -473 | -2030 | -1419 | -515 | -1548 | 1250 | -1750 | -1035 | -569 | -1741 | -184 | -76 | -652 | ▓ | -1225 | -2043 | -1605 | 6 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 7(P) | -453 | -1271 | -792 | -423 | -2113 | -1308 | -480 | -1789 | 138 | -1875 | -1095 | -508 | ▓ | -134 | 1323 | 87 | -556 | -1368 | -2082 | -1622 | 7 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 8(E) | 540 | -2335 | 997 | ▓ | -2648 | -1254 | -347 | -2412 | -241 | -2400 | -1594 | 99 | -1622 | 34 | -857 | -639 | -843 | -1973 | -2617 | -1835 | 8 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | | -1115 | -701 | -1378 | * | | | | | | | | | | | | | |
| 9(D) | -1212 | -2696 | ▓ | 333 | -2575 | -1370 | 2184 | -2849 | -658 | -2784 | -2085 | -32 | -1828 | -282 | -1310 | -968 | -1255 | -2414 | -2702 | -1831 | 9 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 10(R) | -1360 | -2277 | -1623 | -673 | -2899 | -2052 | 1299 | -2378 | 2306 | -2139 | -1406 | -717 | -2040 | 268 | ▓ | -1247 | -1137 | -2097 | -2071 | -1820 | 10 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | | -1115 | -701 | -1378 | * | | | | | | | | | | | | | |
| 11(F) | -2605 | -2164 | -3410 | -3518 | ▓ | -3034 | -940 | -1504 | -3300 | -1072 | -1142 | -2698 | -3246 | -2697 | -2999 | -2815 | -2670 | -1743 | -274 | 806 | 11 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 12(T) | -29 | -659 | -1587 | -1468 | -2300 | -927 | -1414 | -1919 | -1399 | -2228 | -1440 | -1037 | -1583 | -1249 | -1574 | 1473 | ■ | -1259 | -2551 | -2190 | 12 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 13(F) | -2605 | -2164 | -3410 | -3518 | ■ | -3034 | -940 | -1504 | -3300 | -1072 | -1142 | -2698 | -3246 | -2697 | -2999 | -2815 | -2670 | -1743 | -274 | 806 | 13 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 14(G) | -1815 | -2026 | -2479 | -2749 | -3578 | ■ | -2701 | -3848 | -3053 | -3865 | -3355 | -2493 | -2700 | -2875 | -2985 | -2041 | -2188 | -3149 | -3082 | -3440 | 14 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 15(L) | -2228 | -1908 | -3555 | -3373 | -604 | -3255 | -2515 | -62 | -2963 | ■ | 358 | -3207 | -3275 | -2644 | -2802 | -2988 | -2232 | -567 | -1904 | -1643 | 15 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 16(W) | -3232 | -2594 | -3508 | -3648 | -882 | -2917 | -1886 | -3060 | -3237 | -2665 | -2615 | -3229 | -3282 | -3161 | -2996 | -3457 | -3341 | -3103 | ■ | -495 | 16 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 17(T) | -665 | -1148 | -2040 | -2098 | -2442 | -1424 | -1936 | -1850 | -1956 | -2305 | -1815 | -1645 | -2071 | -1911 | -2001 | -909 | ■ | -1444 | -2672 | -2426 | 17 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 18(V) | -1365 | -986 | -3741 | -3350 | -1294 | -3426 | -2948 | 1806 | -3144 | -231 | -144 | -3097 | -3349 | -2976 | -3194 | -2702 | -1365 | ■ | -2628 | -2205 | 18 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 19(G) | -1815 | -2026 | -2479 | -2749 | -3578 | ■ | -2701 | -3848 | -3053 | -3865 | -3355 | -2493 | -2700 | -2875 | -2985 | -2041 | -2188 | -3149 | -3082 | -3440 | 19 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 20(W) | -1622 | -1592 | -2164 | -1843 | 1022 | -2585 | -106 | -1330 | -1522 | -1235 | -864 | 1189 | -2631 | -1288 | -1607 | -1710 | -1559 | -1277 | ■ | 2199 | 20 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 21(Q) | -321 | -1138 | -459 | 136 | -1344 | -1359 | -136 | -875 | 203 | -1115 | -365 | -201 | -1496 | ■ | -180 | 368 | 1172 | 505 | -1531 | -1013 | 21 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 22(G) | 1024 | -757 | -1652 | -1777 | -2766 | ■ | -1806 | -2449 | -1965 | -2750 | -1944 | -1230 | -1687 | -1701 | -2063 | -356 | -543 | -1600 | -2942 | -2694 | 22 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 23(R) | 1048 | -1275 | -1018 | -415 | -1643 | -1529 | -292 | -1159 | 404 | -641 | -643 | -522 | -1703 | 44 | ■ | -628 | -541 | -930 | -1713 | -1274 | 23 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 24(D) | -2059 | -2867 | ■ | -532 | -3452 | -1877 | -1516 | -3665 | -1847 | -3616 | -3145 | -882 | -2414 | -1318 | -2469 | -1872 | -2198 | -3236 | -3167 | -2847 | 24 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 25(P) | 963 | -839 | -1538 | -1576 | -2513 | -1059 | -1614 | -2104 | -1628 | -2420 | -1708 | -1177 | ▓▓▓▓ | -1478 | -1771 | -442 | -597 | -1456 | -2726 | -2418 | 25 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 26(F) | -2605 | -2164 | -3410 | -3518 | ▓▓▓▓ | -3034 | -940 | -1504 | -3300 | -1072 | -1142 | -2698 | -3246 | -2697 | -2999 | -2815 | -2670 | -1743 | -274 | 806 | 26 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 27(G) | -1815 | -2026 | -2479 | -2749 | -3578 | ▓▓▓▓ | -2701 | -3848 | -3053 | -3865 | -3355 | -2493 | -2700 | -2875 | -2985 | -2041 | -2188 | -3149 | -3082 | -3440 | 27 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 28(D) | -597 | -1663 | ▓▓▓▓ | 181 | -2185 | 187 | -451 | -1754 | -339 | -1983 | -1221 | -104 | -1612 | -106 | -878 | -546 | -665 | 506 | -2311 | -1660 | 28 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 29(A) | ▓▓▓▓ | -720 | -1681 | -1630 | -2405 | -986 | -1571 | -1985 | -1615 | -2310 | -1559 | -1157 | 760 | -1436 | -1759 | -333 | -477 | -1332 | -2646 | -2336 | 29 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 30(T) | -341 | -685 | -2089 | -1804 | -1436 | -1424 | -1480 | -3 | -1550 | -954 | -534 | -1410 | -1930 | -1436 | -1668 | -700 | ▓▓▓▓ | 1255 | -2050 | -1664 | 30 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 31(R) | -2176 | -2415 | -2504 | -1923 | -3054 | -2403 | -1269 | -3053 | -167 | -2856 | -2350 | -1844 | -2662 | -997 | ▓▓▓▓ | -2228 | -2131 | -2807 | -2501 | -2452 | 31 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 32(E) | -248 | -1658 | -85 | ▓▓▓▓ | -1958 | -810 | 119 | -1690 | 834 | -1663 | -757 | 139 | 985 | 778 | 456 | 381 | 316 | -1270 | -1853 | -1189 | 32 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 33(A) | ▓▓▓▓ | -1507 | 557 | 375 | -1789 | -501 | 65 | -1489 | 442 | -1529 | -658 | 597 | -1340 | 492 | 860 | -168 | -194 | -459 | -1775 | -1142 | 33 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 34(L) | -2228 | -1908 | -3555 | -3373 | -604 | -3255 | -2515 | -62 | -2963 | ▓▓▓▓ | 358 | -3207 | -3275 | -2644 | -2802 | -2988 | -2232 | -567 | -1904 | -1643 | 34 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 35(D) | -2059 | -2867 | 233 | -532 | -3452 | -1877 | -1516 | -3665 | -1847 | -3616 | -3145 | -882 | -2414 | -1318 | -2469 | -1872 | -2198 | -3236 | -3167 | -2847 | 35 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 36(P) | -441 | -915 | -1763 | -1646 | -1764 | -1345 | -1491 | -927 | -1474 | -1451 | -1021 | -1327 | ▓▓▓▓ | -1412 | -1607 | -703 | -724 | 708 | -2237 | -1825 | 36 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 37(V) | 335 | -792 | -3174 | -2729 | -1174 | -2763 | -2203 | 1517 | -2499 | -357 | -111 | -2444 | -2850 | -2311 | -2556 | -1972 | -1037 | ▓▓▓▓ | -2170 | -1771 | 37 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 38(E) | -909 | -1965 | 24 | ▓ | -1246 | -1505 | -347 | -1841 | -213 | -1874 | -1207 | -228 | -1785 | -120 | -648 | -805 | -890 | -1573 | -1601 | 1568 | 38 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 39(A) | ▓ | -630 | -1276 | -809 | -1410 | 236 | -731 | -999 | -672 | -1275 | -522 | -711 | -1520 | -537 | -976 | 877 | 1188 | 793 | -1715 | -1298 | 39 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 40(V) | -529 | -1877 | -2238 | -2105 | -1525 | -7 | -1733 | 111 | -1947 | -1096 | -672 | -1661 | -2112 | -1793 | -1998 | -945 | -758 | ▓ | -2136 | -1758 | 40 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 41(H) | -582 | -1877 | -351 | 773 | -2233 | -1449 | ▓ | -1912 | 686 | -1839 | -988 | -97 | -1545 | 1646 | 1256 | -467 | -492 | -1531 | -1962 | -1406 | 41 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 42(R) | -1587 | -2371 | -1979 | -913 | -3101 | -2190 | -224 | -2514 | 2541 | -2236 | -1542 | -885 | -2171 | 194 | ▓ | -1477 | -1330 | -2260 | -2127 | -1955 | 42 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 43(L) | -1974 | -1575 | -4060 | -3545 | -282 | -3812 | -2663 | 1310 | -3204 | ▓ | 857 | -3408 | -3401 | -2583 | -3003 | -3063 | -1891 | 178 | -1830 | -1733 | 43 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 44(A) | ▓ | -604 | -1805 | -1733 | -2482 | -871 | -1613 | -2129 | -1700 | -2432 | -1611 | -1136 | -1569 | -1478 | -1829 | 1682 | -361 | -1353 | -2728 | -2414 | 44 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 45(E) | -1003 | -2473 | 512 | ▓ | -2788 | -831 | -430 | -2578 | -247 | -2533 | -1768 | 24 | -1719 | 707 | -767 | -793 | -1016 | -2149 | -2707 | -1955 | 45 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 46(L) | -1959 | -1558 | -4063 | -3546 | -291 | -3808 | -2666 | 1414 | -3212 | ▓ | 850 | -3406 | -3399 | -2589 | -3010 | -3056 | -1876 | 210 | -1837 | -1742 | 46 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 47(G) | -1815 | -2026 | -2479 | -2749 | -3578 | ▓ | -2701 | -3848 | -3053 | -3865 | -3355 | -2493 | -2700 | -2875 | -2985 | -2041 | -2188 | -3149 | -3082 | -3440 | 47 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 48(A) | ▓ | -638 | -2146 | -1978 | -1831 | -1146 | -1655 | -629 | -1782 | -1443 | -953 | -1374 | -1775 | -1605 | -1861 | -461 | -489 | 571 | -2360 | -2006 | 48 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 49(Y) | -2410 | -2105 | -2586 | -2487 | 1214 | -3046 | 2815 | -1980 | -2072 | -1592 | -1442 | -1863 | -3075 | -1758 | -2026 | -2294 | -2336 | -2000 | 511 | ▓ | 49 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 50(G) | -1815 | -2026 | -2479 | -2749 | -3578 | ▓ | -2701 | -3848 | -3053 | -3865 | -3355 | -2493 | -2700 | -2875 | -2985 | -2041 | -2188 | -3149 | -3082 | -3440 | 50 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 51(V) | -1387 | -977 | -3821 | -3371 | -1118 | -3516 | -2833 | 2100 | -3172 | 597 | 34 | -3124 | -3343 | -2908 | -3170 | -2752 | -1359 | ▓▓▓ | -2430 | -2081 | 51 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 52(T) | -316 | -1039 | -679 | -633 | -2149 | -1120 | -926 | -1803 | -741 | -2069 | -1321 | 1353 | -1653 | -671 | -1045 | -444 | ▓▓▓ | -1311 | -2344 | -1843 | 52 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 53(F) | -2065 | -1675 | -3615 | -3327 | ▓▓▓ | -3380 | -1003 | -121 | -2974 | 1209 | 326 | -2658 | -3213 | -2303 | -2729 | -2622 | -1996 | -549 | -310 | 671 | 53 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 54(H) | -2323 | -2419 | -1868 | -1956 | -1368 | -2396 | ▓▓▓ | -3143 | -1645 | -2924 | -2595 | -1989 | -2806 | -1873 | -1712 | -2381 | -2439 | -2923 | -1719 | -395 | 54 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 55(D) | -2059 | -2867 | ▓▓▓ | -532 | -3452 | -1877 | -1516 | -3665 | -1847 | -3616 | -3145 | -882 | -2414 | -1318 | -2469 | -1872 | -2198 | -3236 | -3167 | -2847 | 55 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 56(D) | -1205 | -3003 | ▓▓▓ | -3203 | -3203 | -1271 | -537 | -3082 | -663 | -2979 | -2251 | 1491 | -1755 | -188 | -1433 | -903 | -1247 | -2583 | -3173 | -2230 | 56 |
| — | -149 | -500 | 233 | 1455 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 57(D) | -1425 | -3134 | ▓▓▓ | 881 | -3374 | -1343 | -726 | -3296 | -972 | -3221 | -2585 | 25 | -1881 | -410 | -1787 | -1106 | -1504 | -2808 | -3355 | -2435 | 57 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 58(L) | -2228 | -1908 | -3555 | -3373 | -604 | -3255 | -2515 | -62 | -2963 | ▓▓▓ | 358 | -3207 | -3275 | -2644 | -2802 | -2988 | -2232 | -567 | -1904 | -1643 | 58 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 59(I) | -584 | -415 | -2576 | -2004 | 811 | -2186 | -1087 | ▓▓▓ | -1704 | -44 | 421 | -179 | -2212 | -1418 | -1667 | -1280 | -535 | 1582 | -1034 | -637 | 59 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 60(P) | 831 | -858 | -1530 | -1581 | -2527 | -1073 | -1627 | -2121 | -1640 | -2436 | -1732 | -1189 | ▓▓▓ | -1494 | -1780 | -462 | -619 | -1475 | -2736 | -2431 | 60 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 61(F) | -1404 | -1445 | -2265 | -1857 | ▓▓▓ | -2371 | -514 | -956 | -1089 | -826 | -548 | -1590 | -2505 | -1217 | 1154 | -1633 | -1384 | -986 | -276 | 725 | 61 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 62(G) | -1147 | -2145 | 1555 | -151 | -3123 | ▓▓▓ | -1064 | -3044 | -1224 | -3073 | -2375 | -443 | -1969 | -787 | -1831 | -1065 | -1335 | -2467 | -3051 | -2494 | 62 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 63(S) | 1540 | -619 | -1644 | -1374 | -2259 | -896 | -1302 | -1897 | -1273 | -2159 | -1334 | -974 | -1528 | -1100 | -1502 | ▓▓▓ | 1259 | -1223 | -2486 | -2129 | 63 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 64(T) | -278 | -1411 | 820 | 210 | -1980 | -1166 | -168 | -1685 | 139 | -1746 | -888 | -45 | 610 | 235 | -352 | 1310 | ▓▓▓▓ | -1258 | -1999 | -1378 | 64 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 65(D) | 775 | -2108 | ▓▓▓▓ | 884 | -2418 | -1237 | -217 | -2176 | -19 | -2160 | -1317 | 112 | 719 | 185 | -599 | -488 | -639 | -1745 | -2375 | -1635 | 65 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 66(Q) | 1223 | -1288 | -293 | 188 | -1719 | -1202 | -83 | -1395 | 258 | -1490 | -649 | 435 | -1388 | ▓▓▓▓ | -204 | 588 | 1044 | -1031 | -1779 | -1191 | 66 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 67(E) | -786 | -1958 | 234 | ▓▓▓▓ | -2471 | -1312 | -479 | -2090 | -260 | -2221 | -1480 | -118 | -1693 | -120 | -738 | -684 | 705 | -1709 | -2489 | -1828 | 67 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 68(R) | -2176 | -2415 | -2504 | -1923 | -3054 | -2403 | -1269 | -3053 | -167 | -2856 | -2350 | -1844 | -2662 | -997 | -305 | -2228 | -2131 | -2807 | -2501 | -2452 | 68 |
| — | -149 | -500 | 233 | -381 | 399 | 106 | -626 | 210 | -466 | -720 | 275 | 394 | 45 | 96 | 359 | 117 | -369 | -294 | -249 | | |
| — | -86 | -4238 | -7714 | -942 | -1061 | -1227 | -60 | -2029 | 241 | -1986 | -1104 | 146 | -1438 | 1147 | ▓▓▓▓ | -338 | -450 | -1591 | -2174 | -880 | |
| 69(E) | 180 | -1985 | 1618 | ▓▓▓▓ | -2269 | -1227 | -60 | -2029 | 241 | -1986 | -1104 | 146 | -1438 | 1147 | -305 | -338 | -450 | -1591 | -2174 | -880 | 71 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 70(Q) | -93 | -1588 | -113 | 706 | -1865 | -138 | 790 | -1583 | 816 | -888 | -690 | 129 | -1311 | ▓▓▓▓ | 26 | 758 | 459 | -1186 | -1798 | -1145 | 72 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 71(H) | -345 | -877 | -695 | -213 | -903 | -685 | ▓▓▓▓ | -776 | 31 | -776 | -65 | -380 | -1577 | 906 | -283 | -494 | -289 | -359 | -1209 | -725 | 73 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 72(I) | -367 | -817 | -3505 | -3009 | -998 | -3128 | -2307 | 1646 | -2771 | 715 | 78 | -2719 | -3035 | -2503 | -2747 | -2310 | -1131 | 2143 | -2063 | -1704 | 74 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 73(K) | 361 | -1699 | 596 | 415 | -2015 | -63 | 90 | -1743 | 816 | -1710 | -809 | 113 | -1347 | 537 | 931 | -183 | -235 | -1322 | -1892 | -1235 | 75 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 74(R) | -320 | -1614 | 442 | 360 | -1920 | -41 | 31 | -1626 | 443 | -1643 | -772 | 621 | -1381 | 460 | ▓▓▓▓ | -229 | -270 | -563 | -1865 | -1229 | 76 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 75(F) | -324 | -1039 | -2854 | -2418 | ▓▓▓▓ | -2568 | -1007 | 160 | -2106 | 857 | 406 | -2027 | -2596 | -1719 | -2040 | -1726 | -1158 | -29 | -596 | 214 | 77 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 76(K) | -650 | -1908 | -584 | 44 | -2320 | -1534 | 916 | -1965 | ▓▓▓▓ | -1862 | -1018 | 553 | -1598 | 439 | 1858 | 2 | -543 | -1590 | -1953 | -1448 | 78 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 77(Q) | 71 | -1748 | -305 | 251 | -2095 | -183 | 48 | -1783 | 1408 | -1737 | -866 | -20 | -1452 | | 774 | -328 | -355 | -1392 | -1894 | -1306 | 79 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 78(A) | | -723 | -1876 | -1947 | -2635 | -214 | -1832 | -2241 | -1993 | -2601 | -1822 | -1305 | -1695 | -1754 | -2055 | -360 | -529 | -1479 | -2845 | -2605 | 80 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 79(L) | -1818 | -1523 | -3759 | -3310 | -316 | -3460 | -2478 | 536 | -2926 | | 784 | -3124 | -3244 | -2443 | -2783 | -2733 | -1782 | 616 | -1795 | -1623 | 81 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 80(D) | 101 | -1863 | | 425 | -2206 | -1222 | -98 | -1948 | 669 | -1938 | -1069 | 103 | -382 | 321 | -339 | 397 | -446 | -1522 | -2148 | -1452 | 82 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 81(E) | 1195 | -2299 | 1673 | | -2594 | -1247 | -290 | -2366 | -151 | -2338 | -1512 | 118 | -1587 | 102 | -761 | -582 | -772 | -1923 | -2546 | -1769 | 83 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 82(T) | -194 | -791 | -1643 | -1654 | -2474 | 22 | -1622 | -2066 | -1652 | -2413 | -1662 | -1202 | -1715 | -1503 | -1776 | -414 | | -1411 | -2683 | -2390 | 84 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 83(G) | 439 | -855 | -1581 | -1757 | -2835 | | -1850 | -2546 | -2010 | -2843 | -2063 | -1269 | -1756 | -1754 | -2106 | -457 | -649 | -1703 | -2977 | -2743 | 85 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 84(M) | -740 | -586 | -2676 | -2080 | -191 | -930 | -1155 | 1108 | -1758 | 1717 | | -1802 | -2271 | -1414 | -1692 | -1385 | -677 | 372 | -1016 | -731 | 86 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 85(K) | -131 | -982 | -588 | -21 | -1093 | -1402 | -93 | 359 | | -893 | -147 | -231 | -1484 | 210 | 265 | -362 | 838 | 279 | -1327 | -833 | 87 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 86(V) | -521 | -748 | -233 | -1105 | -1131 | -1713 | -1055 | 404 | -1134 | -720 | -220 | -1100 | -2000 | -969 | -1389 | -914 | 300 | | -1701 | -1269 | 88 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 87(P) | -1095 | -1645 | -1418 | -1291 | -2556 | -1705 | -1272 | -2442 | -720 | -2498 | -1867 | -1276 | | -1049 | 408 | -1217 | -1284 | -2022 | -2467 | -2195 | 89 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 88(M) | -953 | -1122 | -1705 | -1356 | -305 | -2019 | 883 | -460 | -763 | -333 | | -1283 | -2194 | -908 | -858 | -1254 | -950 | -521 | -955 | -237 | 90 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 89(V) | 1289 | -665 | -1346 | -207 | -986 | -1604 | -837 | 217 | -874 | -666 | -98 | -970 | -1860 | -753 | -1115 | -757 | -455 | | -1481 | -1067 | 91 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 90(T) | -194 | -791 | -1643 | -1654 | -2474 | 22 | -1622 | -2066 | -1652 | -2413 | -1662 | -1202 | -1715 | -1503 | -1776 | -414 | | -1411 | -2683 | -2390 | 92 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 91(T) | 1048 | -603 | -1704 | -1538 | -2267 | 288 | -1432 | -1863 | -1474 | -2173 | -1368 | -1056 | -1558 | -1278 | -1649 | -205 | | -1204 | -2525 | -2195 | 93 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 92(N) | -1161 | -2498 | 1023 | 254 | -2901 | -1337 | -713 | -2897 | -803 | -2894 | -2199 | | -1842 | -402 | -1449 | -964 | -1262 | -2411 | -2948 | -2145 | 94 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 93(L) | -1075 | -1199 | -2228 | -2047 | -923 | -434 | -1571 | -385 | -1753 | | -140 | -1841 | -2396 | -1672 | -1788 | -1474 | -1191 | -504 | -1704 | -1322 | 95 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 94(F) | -1621 | -1684 | -10 | -1676 | | -2340 | -642 | -1251 | -1954 | -1200 | -952 | -1552 | -2602 | -1572 | -2091 | -1778 | -1662 | -1250 | -309 | 743 | 96 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 95(T) | -248 | -1135 | 326 | -166 | -2058 | -1097 | -537 | -1731 | -339 | -1883 | -1065 | -315 | -1509 | -198 | -783 | 1772 | | -1257 | -2181 | -1628 | 97 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 96(H) | 265 | -2079 | 1321 | 773 | -2325 | -1256 | | -2082 | 19 | -2080 | -1247 | 103 | -1537 | 198 | -538 | -495 | -631 | -1679 | -2300 | -1577 | 98 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 97(P) | -2089 | -2190 | -2567 | -2787 | -3372 | -2253 | -2663 | -3607 | -2895 | -3590 | -3215 | -2612 | | -2846 | -2839 | -2316 | -2418 | -3135 | -2975 | -3234 | 99 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 98(V) | 479 | -552 | -2113 | -1863 | -1375 | -3 | -1443 | -29 | -1694 | -1045 | 494 | -1385 | -1851 | -1485 | -1768 | -608 | -468 | | -1913 | -1556 | 100 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 99(F) | -2377 | -1971 | -2987 | -2956 | | -3100 | 1295 | -1675 | -2615 | -1307 | -1196 | -2083 | -3140 | -2054 | -2431 | -2384 | -2334 | -1754 | 478 | 1631 | 101 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 100(K) | -186 | -1836 | -969 | -558 | -2577 | -1685 | -425 | -2088 | | -2110 | -1410 | -652 | -1925 | -45 | 429 | -978 | -981 | -1757 | -2208 | -1848 | 102 |
| — | -149 | -498 | 233 | 43 | -381 | 399 | 106 | -626 | 210 | -466 | -720 | 275 | 394 | 45 | 96 | 359 | 117 | -369 | -294 | -249 | |
| — | -86 | -4238 | -7714 | -1698 | -532 | -701 | -1378 | * | * | | | | | | | | | | | | |
| 101(D) | -2059 | -2867 | | -532 | -3452 | -1877 | -1516 | -3665 | -1847 | -3616 | -3145 | -882 | -2414 | -1318 | -2469 | -1872 | -2198 | -3236 | -3167 | -2847 | 108 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 102(G) | -920 | -1508 | -1339 | -1295 | -2751 | | -1377 | -2630 | -937 | -2716 | -2012 | -1241 | -2085 | -1160 | 523 | -1056 | -1170 | -2071 | -2626 | -2390 | 109 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -102 | -6672 | -4094 | | | -701 | | | | | | | | | | | | | | | |

TABLE 1-continued

HMMER2.0 [2.2g][1]  
NAME seed-short[2]  
LENG 397[3]  
ALPH Amino[4]  
MAP yes[5]  
NSEQ 21[6]  
DATE Mon Oct 19 14:08:50 2009[7]  
XT -8455 -4 -1000 -1000 -8455 -4 -8455 -4  
NULT -4 -8455[8]  
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 103(G) | 1678 | -647 | -1598 | -1653 | -2595 | ▨ | -1650 | -2259 | -1777 | -2558 | -1746 | -1116 | -1581 | -1527 | -1899 | -241 | -417 | -1446 | -2792 | -2519 | 110 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -22 | -6592 | -7635 | -894 | -1115 | -618 | -1521 | * | | | | | | | | | | | | | |
| 104(F) | -2605 | -2164 | -3410 | -3518 | ▨ | -3034 | -940 | -1504 | -3300 | -1072 | -1142 | -2698 | -3246 | -2697 | -2999 | -2815 | -2670 | -1743 | -274 | 806 | 111 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 105(T) | -665 | -1148 | -2040 | -2098 | -2442 | -1424 | -1936 | -1850 | -1956 | -2305 | -1815 | -1645 | -2071 | -1911 | -2001 | -909 | ▨ | -1444 | -2672 | -2426 | 112 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 106(S) | 2001 | -616 | -1754 | -1668 | -2497 | -871 | -1578 | -2157 | -1641 | -2446 | -1619 | -1109 | -1565 | -1427 | -1789 | ▨ | -361 | -1370 | -2732 | -2410 | 113 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 107(N) | -603 | -1690 | -182 | 42 | -2219 | -1348 | -286 | -1949 | 226 | -1968 | -1162 | ▨ | 26 | 97 | 673 | -546 | -618 | -1549 | -2135 | -1563 | 114 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 108(D) | -2059 | -2867 | ▨ | -532 | -3452 | -1877 | -1516 | -3665 | -1847 | -3616 | -3145 | -882 | -2414 | -1318 | -2469 | -1872 | -2198 | -3236 | -3167 | -2847 | 115 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 109(R) | -1150 | -1864 | -1429 | -882 | -2591 | -1829 | -597 | -2283 | 393 | -2219 | -1523 | -923 | -1080 | -238 | ▨ | -1166 | -1141 | -1945 | -2211 | -1924 | 116 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 110(W) | 344 | -1328 | 1619 | 227 | -1582 | -1248 | -77 | -1278 | 216 | -1399 | -584 | -39 | -1418 | 299 | -257 | 1029 | -265 | -964 | ▨ | -1101 | 117 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 111(V) | -1349 | -988 | -3690 | -3306 | -1278 | -3360 | -2895 | 1671 | -3086 | -226 | -141 | -3047 | -3312 | -2925 | -3136 | -2638 | -1356 | ▨ | -2597 | -2168 | 118 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 112(R) | -2176 | -2415 | -2504 | -1923 | -3054 | -2403 | -1269 | -3053 | -167 | -2856 | -2350 | -1844 | -2662 | -997 | ▨ | -2228 | -2131 | -2807 | -2501 | -2452 | 119 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 113(R) | 1106 | -1210 | -925 | -462 | -2109 | -352 | -466 | -1735 | 167 | -1836 | -1045 | -526 | -1629 | -112 | ▨ | -468 | -502 | -1309 | -2063 | -1625 | 120 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 114(Y) | -1833 | -1522 | -3003 | -2757 | 2546 | -2889 | -152 | -1096 | -2433 | -987 | -712 | -1944 | -2891 | -1848 | -2268 | -2038 | -243 | -1114 | 464 | ▨ | 121 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |
| 115(A) | ▨ | -913 | -1413 | -1186 | -2083 | -1183 | -1104 | -1652 | -747 | -1929 | -1234 | -982 | -1727 | -890 | 214 | -497 | -570 | -1201 | -2274 | -1896 | 122 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 116(I) | -818 | 1001 | -3111 | -2515 | 678 | -2491 | -1402 | ▨ | -2173 | 1686 | 640 | -2108 | -2446 | -1766 | -2010 | -1604 | -758 | 1207 | -1150 | -857 | 123 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 117(R) | 615 | -1244 | -985 | -490 | -2134 | -1326 | -441 | -1752 | 263 | -1841 | -1057 | -543 | -1650 | -82 | ▨ | 238 | -530 | -1334 | -2053 | -1625 | 124 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 118(K) | -1518 | -2307 | -1691 | -846 | -2975 | -2112 | -281 | -2466 | ▨ | -2235 | -1545 | -856 | -2148 | 126 | 1301 | -1423 | -1307 | -2203 | -2146 | -1935 | 125 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 119(V) | 334 | -503 | -1661 | -1221 | -1131 | -1220 | -917 | -428 | -1040 | -959 | -283 | -984 | -1644 | -868 | -1235 | 814 | 1722 | ▨ | -1545 | -1167 | 126 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 120(I) | -1801 | -1400 | -4009 | -3498 | -409 | -3715 | -2658 | ▨ | -3194 | 2239 | 733 | -3319 | -3361 | -2625 | -3020 | -2951 | -1730 | 515 | -1907 | -1779 | 127 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 121(R) | -590 | -1886 | -363 | 992 | -2256 | -1091 | 1110 | -1926 | 695 | -1849 | -997 | -103 | -1551 | 997 | ▨ | -475 | -499 | -1544 | -1970 | -1419 | 128 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 122(N) | -525 | -1683 | 10 | 202 | -2130 | -1278 | -228 | -1842 | 152 | -1887 | -1070 | ▨ | -1544 | 1246 | -266 | -453 | 843 | -1452 | -2112 | -1492 | 129 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 123(M) | -1469 | -1138 | -3630 | -3124 | -557 | -3307 | -2344 | 2828 | -2803 | 593 | ▨ | -2896 | -3124 | -2415 | -2714 | -2510 | -1422 | 784 | -1868 | -1641 | 130 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 124(D) | -2059 | -2867 | ▨ | -532 | -3452 | -1877 | -1516 | -3665 | -1847 | -3616 | -3145 | -882 | -2414 | -1318 | -2469 | -1872 | -2198 | -3236 | -3167 | -2847 | 131 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 125(L) | -2228 | -1908 | -3555 | -3373 | -604 | -3255 | -2515 | -62 | -2963 | ▨ | 358 | -3207 | -3275 | -2644 | -2802 | -2988 | -2232 | -567 | -1904 | -1643 | 132 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 126(A) | ▨ | -677 | -1768 | -1791 | -2628 | 1691 | -1726 | -2289 | -1863 | -2588 | -1770 | -1201 | -1631 | -1609 | -1973 | -280 | -452 | -1476 | -2836 | -2569 | 133 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 127(A) | ▨ | -636 | -2232 | -1987 | -1562 | -1335 | -1616 | -72 | -1780 | -1097 | -650 | -1463 | -1894 | -1599 | -1867 | -627 | -539 | 1482 | -2167 | -1804 | 134 |
| — | -149 | -500 | 233 | -894 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 128(E) | -1877 | -2708 | -271 | ▨ | -3235 | -1868 | -1322 | -3210 | -1299 | -3203 | -2676 | -849 | -2342 | -1076 | -1736 | -1723 | -1961 | -2857 | -2976 | -2640 | 135 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 129(L) | -992 | -910 | -2475 | -1914 | -111 | -2437 | 615 | 229 | -1462 | ▓ | 1583 | -1768 | -2392 | -1292 | -1486 | -1534 | -923 | -34 | -1023 | -591 | 136 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 130(G) | -302 | -865 | -1762 | -1813 | -2349 | ▓ | -1733 | -1847 | -1826 | -2301 | -1669 | -1332 | -1811 | -1666 | -1921 | -535 | -673 | -35 | -2637 | -2293 | 137 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 131(A) | ▓ | -995 | -2154 | -2261 | -2604 | -1267 | -2060 | -2035 | -2233 | -2502 | -1934 | -1631 | -1961 | -2058 | -2240 | -724 | -871 | -1499 | -2817 | -2619 | 138 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 132(K) | -495 | -1865 | -2571564 | -2231 | -1381 | 33 | -1927 | ▓ | -1845 | -968 | | -21 | -1480 | 1087 | 678 | -101 | -414 | -1517 | -1970 | -1379 | 139 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 133(T) | 15 | -567 | -2088 | -1580 | -827 | -1880 | -1130 | 1432 | -1354 | -387 | 83 | -1415 | -2081 | -1179 | -1499 | -1015 | ▓ | 1019 | -1446 | -1065 | 140 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 134(Y) | -1352 | -1117 | -2812 | -2425 | 2395 | -2595 | -217 | -654 | -2102 | 398 | -289 | -1774 | -2598 | -1607 | -1976 | -504 | -1284 | -635 | 320 | ▓ | 141 |
| — | -149 | -500 | 233 | -381 | 399 | 106 | -626 | 210 | -466 | -720 | 275 | 394 | 45 | 96 | 359 | 118 | -369 | -294 | -249 | | |
| — | -86 | -4238 | -7714 | -894 | -1626 | -701 | -1378 | * | * | | | | | | | | | | | | |
| 135(V) | -879 | 1157 | -3282 | -2943 | -1304 | -2350 | -2295 | 1015 | -2647 | -535 | -296 | -2399 | -2667 | -2450 | -2627 | -1648 | -1002 | ▓ | -2267 | -1857 | 143 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 136(M) | 1321 | -485 | -2344 | -1767 | -356 | -2101 | -1016 | 611 | -1491 | 715 | ▓ | -1554 | -2136 | -1223 | -1516 | -1184 | -533 | 1286 | -1047 | -714 | 144 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 137(W) | -3232 | -2594 | -3508 | -3648 | -882 | -2917 | -1886 | -3060 | -3237 | -2665 | -2615 | -3229 | -3282 | -3161 | -2996 | -3457 | -3341 | -3103 | ▓ | -495 | 145 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 138(G) | -629 | -1215 | -1479 | -1608 | -2971 | ▓ | -1817 | -2847 | -1898 | -3004 | -2246 | -1366 | 1410 | -1693 | -2073 | -816 | -993 | -2058 | -2924 | -2780 | 146 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 139(G) | -1815 | -2026 | -2479 | -2749 | -3578 | ▓ | -2701 | -3848 | -3053 | -3865 | -3355 | -2493 | -2700 | -2875 | -2985 | -2041 | -2188 | -3149 | -3082 | -3440 | 147 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 140(R) | -2176 | -2415 | -2504 | -1923 | -3054 | -2403 | -1269 | -3053 | -167 | -2856 | -2350 | -1844 | -2662 | -997 | ▓ | -2228 | -2131 | -2807 | -2501 | -2452 | 148 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |
| 141(E) | -1877 | -2708 | -271 | ▓ | -3235 | -1868 | -1322 | -3210 | -1299 | -3203 | -2676 | -849 | -2342 | -1076 | -1736 | -1723 | -1961 | -2857 | -2976 | -2640 | 149 |
| — | -149 | -500 | 233 | -381 | 399 | 106 | -626 | 210 | -466 | -720 | 275 | 394 | 45 | 96 | 359 | 117 | -369 | -294 | -249 | | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 142(G) | -1815 | -2026 | -2479 | -2749 | -3578 | ▨ | -2701 | -3848 | -3053 | -3865 | -3355 | -2493 | -2700 | -2875 | -2985 | -2041 | -2188 | -3149 | -3082 | -3440 | 150 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 143(A) | ▨ | -600 | -1841 | -1807 | -2491 | -872 | -1666 | -2124 | -1780 | -2447 | -1635 | -1169 | -1579 | -1551 | -1883 | 1108 | -372 | -1350 | -2748 | -2442 | 151 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 144(E) | -1877 | -2708 | -271 | ▨ | -3235 | -1868 | -1322 | -3210 | -1299 | -3203 | -2676 | -849 | -2342 | -1076 | -1736 | -1723 | -1961 | -2857 | -2976 | -2640 | 152 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 145(Y) | -366 | -612 | -1417 | -941 | -254 | -1575 | -466 | -250 | -742 | -584 | 46 | -879 | -1770 | -596 | -952 | 1383 | -382 | 905 | -768 | ▨ | 153 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 146(D) | -1105 | -2793 | ▨ | 1424 | -3056 | 1647 | -501 | -2904 | -567 | -2827 | -2074 | 116 | -1726 | -144 | -1292 | -838 | -1143 | -2419 | -3024 | -2136 | 154 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 147(A) | ▨ | -621 | -1648 | -1495 | -2508 | 1640 | -1463 | -2219 | -1491 | -2440 | -1580 | -1023 | -1533 | -1271 | -1696 | 1504 | -328 | -1400 | -2709 | -2377 | 155 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 148(A) | ▨ | -588 | -1757 | -1515 | -2231 | -893 | -1384 | -1850 | -1406 | -2137 | -1324 | -1039 | -1540 | -1216 | -1597 | 1059 | 1273 | -1189 | -2483 | -2146 | 156 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 149(K) | -1004 | -1906 | -751 | -464 | -2680 | 668 | -524 | -2356 | ▨ | -2305 | -1553 | -618 | -1920 | -150 | 132 | -968 | -1013 | -1956 | -2316 | -1940 | 157 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 150(D) | -1145 | -2665 | ▨ | -1495 | -2959 | -1353 | -536 | -2796 | -1491 | -2743 | -2006 | -1023 | -1786 | -182 | -1024 | -906 | -1172 | -2352 | -2877 | -2097 | 158 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 151(V) | 556 | -703 | -2845 | -2356 | -868 | -2476 | -1724 | 1032 | -2090 | 672 | 119 | -2092 | -2570 | -1874 | -2129 | -1644 | -865 | ▨ | -1729 | -1361 | 159 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 152(R) | 307 | -1186 | -699 | -235 | -2036 | -283 | -362 | -1698 | 145 | -1783 | -956 | -359 | -1520 | 12 | ▨ | 677 | -375 | -1252 | -2024 | -1524 | 160 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 153(D) | 966 | -1545 | ▨ | 387 | -1839 | -201 | 57 | -1545 | 1069 | -1575 | -700 | 91 | -1343 | 486 | -66 | -11 | -210 | -337 | -1814 | -1172 | 161 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 154(A) | ▨ | -635 | -2197 | -1970 | -1633 | -1272 | -1616 | -227 | -1767 | -1190 | -730 | -1428 | -1852 | -1587 | -1854 | -571 | -520 | 1219 | -2215 | -1854 | 162 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 155(W) | -1671 | -1400 | -3325 | -2868 | 233 | -3039 | -1268 | 0 | -2363 | 2540 | 532 | -2472 | -2926 | -1994 | -2227 | -2277 | -1599 | -418 | | 45 | 163 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 156(D) | -1386 | -3150 | | 1221 | -3366 | -1320 | -681 | -3279 | -911 | -3191 | -2536 | 63 | -1851 | -357 | -1729 | -1063 | -1456 | -2785 | -3348 | -2403 | 164 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 157(R) | -1492 | -1910 | -2040 | -1238 | -1130 | -2207 | -499 | -1858 | 364 | -1773 | -1220 | -1192 | -2291 | -345 | | -1537 | -1364 | -1712 | 2966 | -659 | 165 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 158(M) | -671 | -553 | -2451 | -1885 | -21 | -2161 | -868 | 387 | -1554 | 249 | | -1603 | -2178 | -1263 | -1528 | -1248 | -615 | 1153 | -731 | 1912 | 166 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 159(R) | -1586 | -2370 | -1977 | -912 | -3100 | -2189 | -223 | -2513 | 2555 | -2235 | -1541 | -885 | -2170 | 194 | | -1476 | -1329 | -2260 | -2127 | -1954 | 167 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 160(E) | -1877 | -2708 | -271 | | -3235 | -1868 | -1322 | -3210 | -1299 | -3203 | -2676 | -849 | -2342 | -1076 | -1736 | -1723 | -1961 | -2857 | -2976 | -2640 | 168 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 161(A) | | -659 | -1524 | -1392 | -2402 | 874 | -1398 | -2082 | -1414 | -2320 | -1489 | -994 | 377 | -1210 | -1630 | -211 | -359 | -1347 | -2615 | -2271 | 169 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 162(F) | -1311 | -1025 | -3449 | -2891 | | -2994 | -1698 | 606 | -2578 | 1623 | 733 | -2548 | -2836 | -2068 | -2410 | -2134 | -1242 | 1636 | -1220 | -793 | 170 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 163(D) | -1226 | -2864 | | 438 | -3143 | -1293 | -620 | -3082 | -772 | -3012 | -2309 | 2528 | -1798 | -288 | -1527 | -951 | -1296 | -2581 | -3152 | -2243 | 171 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 164(L) | -982 | -834 | -2810 | -2255 | 1392 | -2500 | -1292 | 389 | -1949 | | 736 | -1995 | -2463 | -1577 | -1892 | -1612 | 726 | 161 | -1047 | -640 | 172 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 165(M) | 438 | -905 | -2819 | -2258 | -264 | -2565 | -1490 | 453 | -1943 | 2160 | | -2061 | -2520 | -1607 | -1918 | -1683 | -989 | 202 | -1306 | -1076 | 173 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 166(G) | 2232 | -685 | -1742 | -1778 | -2655 | | -1733 | -2323 | -1870 | -2618 | -1798 | -1198 | -1634 | -1614 | -1983 | -284 | -460 | -1498 | -2857 | -2591 | 174 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 167(E) | 823 | -1941 | 898 | | -2233 | -330 | -41 | -1990 | 272 | -1949 | -1063 | 145 | -1423 | 1246 | -270 | -312 | -417 | -1552 | -2138 | -1425 | 175 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |

TABLE 1-continued

HMMER2.0 [2.2g][1]
NAME seed-short[3]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 168(Y) | -2742 | -2290 | -3014 | -3139 | 701 | -3008 | -615 | -2258 | -2836 | -1879 | -1835 | -2399 | -3220 | -2421 | -2640 | -2733 | -2781 | -2314 | 18 | ▨ | 176 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 169(V) | 631 | -431 | -2194 | -1660 | -618 | -1885 | -1021 | 1372 | -1413 | -302 | 239 | -1431 | -2038 | -1190 | -1486 | 234 | -449 | ▨ | -1192 | -819 | 177 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 170(T) | -500 | -1770 | -32 | 1487 | -2088 | -1320 | -71 | -1768 | 1131 | -1785 | -944 | -2 | -1493 | 344 | -18 | -397 | ▨ | -1398 | -1998 | -1382 | 178 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 171(D) | 437 | -2189 | ▨ | 985 | -2514 | -1237 | -262 | -2284 | -99 | -2259 | -1424 | 112 | -1561 | 134 | -696 | 605 | -707 | -1841 | -2470 | -1711 | 179 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 172(Q) | -1116 | -2167 | -1119 | -394 | -2714 | -1859 | -124 | -2252 | 1946 | -2066 | -1298 | -521 | -1894 | ▨ | 1231 | -1001 | -946 | -1936 | -2060 | -1719 | 180 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 173(G) | -1815 | -2026 | -2479 | -2749 | -3578 | ▨ | -2701 | -3848 | -3053 | -3865 | -3355 | -2493 | -2700 | -2875 | -2985 | -2041 | -2188 | -3149 | -3082 | -3440 | 181 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 174(Y) | -2742 | -2290 | -3014 | -3139 | 701 | -3008 | -615 | -2258 | -2836 | -1879 | -1835 | -2399 | -3220 | -2421 | -2640 | -2733 | -2781 | -2314 | 18 | ▨ | 182 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 175(D) | -827 | -2247 | ▨ | 406 | -2712 | 1546 | -431 | -2510 | -378 | -2495 | -1697 | 868 | -1641 | -63 | -1011 | -654 | -878 | -1542 | -2708 | -1921 | 183 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 176(L) | -604 | -460 | -2538 | -1944 | -130 | -2143 | -956 | 1316 | -1614 | ▨ | 679 | -1640 | -2146 | -1291 | -1551 | -1226 | 89 | 434 | -843 | 1377 | 184 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 177(R) | -1151 | -2083 | -1284 | -523 | -2658 | -1893 | -175 | -2181 | 1390 | -2032 | -1286 | -614 | 244 | 239 | ▨ | -1068 | -991 | -1886 | -2044 | -1735 | 185 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 178(F) | -1690 | -1368 | -3472 | -3107 | ▨ | -3159 | -1180 | 1363 | -2783 | 394 | 347 | -2559 | -3051 | -2224 | -2601 | -2369 | -1641 | 22 | -559 | 349 | 186 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 179(A) | ▨ | -995 | -2154 | -2261 | -2604 | -1267 | -2060 | -2035 | -2233 | -2502 | -1934 | -1631 | -1961 | -2058 | -2240 | -724 | -871 | -1499 | -2817 | -2619 | 187 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 180(I) | -1681 | -1285 | -3919 | -3432 | -552 | -3632 | -2662 | ▨ | -3136 | 1690 | 578 | -3234 | -3343 | -2665 | -3012 | -2872 | -1625 | 767 | -2003 | -1807 | 188 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 181(E) | -1877 | -2708 | -271 | ▓ | -3235 | -1868 | -1322 | -3210 | -1299 | -3203 | -2676 | -849 | -2342 | -1076 | -1736 | -1723 | -1961 | -2857 | -2976 | -2640 | 189 |
|  | -149 | -500 | 233 |  | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 182(P) | -2089 | -2190 | -2567 | -2787 | -3372 | -2253 | -2663 | -3607 | -2895 | -3590 | -3215 | -2612 | ▓ | -2846 | -2839 | -2316 | -2418 | -3135 | -2975 | -3234 | 190 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 183(K) | -1892 | -2397 | -1701 | -1300 | -3050 | -2216 | -948 | -2829 | ▓ | -2696 | -2116 | -1348 | -2450 | -619 | 78 | -1865 | -1815 | -2562 | -2460 | -2321 | 191 |
|  | -149 | -500 | 233 |  | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 184(P) | -2089 | -2190 | -2567 | -2787 | -3372 | -2253 | -2663 | -3607 | -2895 | -3590 | -3215 | -2612 | ▓ | -2846 | -2839 | -2316 | -2418 | -3135 | -2975 | -3234 | 192 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 185(N) | -1468 | -2069 | -762 | -997 | -2634 | -1768 | -1516 | -3059 | -1508 | -3127 | -2580 | ▓ | -2312 | -1391 | -1789 | -1503 | -1700 | -2572 | -2658 | -2191 | 193 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 186(E) | -1877 | -2708 | -271 | ▓ | -3235 | -1868 | -1322 | -3210 | -1299 | -3203 | -2676 | -849 | -2342 | -1076 | -1736 | -1723 | -1961 | -2857 | -2976 | -2640 | 194 |
|  | -149 | -500 | 233 |  | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 187(P) | -2089 | -2190 | -2567 | -2787 | -3372 | -2253 | -2663 | -3607 | -2895 | -3590 | -3215 | -2612 | ▓ | -2846 | -2839 | -2316 | -2418 | -3135 | -2975 | -3234 | 195 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 188(R) | -2176 | -2415 | -2504 | -1923 | -3054 | -2403 | -1269 | -3053 | -167 | -2856 | -2350 | -1844 | -2662 | -997 | ▓ | -2228 | -2131 | -2807 | -2501 | -2452 | 196 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 189(G) | -1815 | -2026 | -2479 | -2749 | -3578 | ▓ | -2701 | -3848 | -3053 | -3865 | -3355 | -2493 | -2700 | -2875 | -2985 | -2041 | -2188 | -3149 | -3082 | -3440 | 197 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 190(D) | -2059 | -2867 | ▓ | -532 | -3452 | -1877 | -1516 | -3665 | -1847 | -3616 | -3145 | -882 | -2414 | -1318 | -2469 | -1872 | -2198 | -3236 | -3167 | -2847 | 198 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 191(I) | -1608 | -1307 | -3432 | -3238 | -1179 | -3095 | -2687 | ▓ | -2941 | -191 | -206 | -2987 | -3216 | -2818 | -2915 | -2635 | -1653 | 832 | -2363 | -1952 | 199 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 192(Y) | -1651 | -1320 | -3317 | -2937 | 1876 | -2994 | -612 | -279 | -2586 | 2172 | 216 | -2231 | -2886 | -1963 | -2359 | -2131 | -1568 | -559 | 4 | ▓ | 200 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 193(L) | -2071 | -1671 | -3975 | -3513 | 1646 | -3704 | -1951 | 276 | -3199 | ▓ | 835 | -3187 | -3331 | -2460 | -2935 | -2941 | -1974 | -311 | -1161 | -569 | 201 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 194(P) | 1158 | -816 | -1549 | -1568 | -2492 | -1042 | -1594 | -2082 | -1610 | -2398 | -1676 | -1163 | | -1455 | -1757 | -417 | -570 | -1432 | -2710 | -2399 | 202 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 195(T) | -665 | -1148 | -2040 | -2098 | -2442 | -1424 | -1936 | -1850 | -1956 | -2305 | -1815 | -1645 | -2071 | -1911 | -2001 | -909 | | -1444 | -2672 | -2426 | 203 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 196(V) | 290 | -736 | -3157 | -2642 | -923 | -2834 | -1963 | 1476 | -2393 | 482 | 102 | -2384 | -2806 | -2152 | -2407 | -1989 | -981 | | -1855 | -1485 | 204 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 197(G) | -1815 | -2026 | -2479 | -2749 | -3578 | | -2701 | -3848 | -3053 | -3865 | -3355 | -2493 | -2700 | -2875 | -2985 | -2041 | -2188 | -3149 | -3082 | -3440 | 205 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 198(H) | -647 | -1406 | -537 | -467 | -1335 | -1374 | | -1931 | -374 | -2000 | -1310 | -576 | -1796 | -456 | -639 | 836 | -788 | -1532 | -1683 | -889 | 206 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 199(A) | | -598 | -1408 | -1011 | -1291 | 553 | -847 | -790 | -855 | -1123 | 1960 | -850 | -1597 | -722 | -1095 | -357 | -292 | -511 | -1660 | -1263 | 207 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 200(L) | -1959 | -1558 | -4063 | -3546 | -291 | -3808 | -2666 | 1414 | -3212 | | 850 | -3406 | -3399 | -2589 | -3010 | -3056 | -1876 | 210 | -1837 | -1742 | 208 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 201(A) | | -995 | -2154 | -2261 | -2604 | -1267 | -2060 | -2035 | -2233 | -2502 | -1934 | -1631 | -1961 | -2058 | -2240 | -724 | -871 | -1499 | -2817 | -2619 | 209 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 202(F) | -2151 | -1753 | -3530 | -3327 | | -3318 | -783 | -347 | -2962 | 686 | 53 | -2548 | -3220 | -2300 | -2714 | -2589 | -2099 | -722 | -95 | 953 | 210 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 203(I) | -1413 | -1022 | -3801 | -3407 | -1219 | -3492 | -2985 | | -3199 | -111 | -62 | -3161 | -3383 | -2998 | -3231 | -2772 | -1408 | 1813 | -2596 | -2206 | 211 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 204(E) | 90 | -1897 | 443 | | -2185 | -1230 | 1725 | -1936 | 326 | -1898 | -1010 | 138 | -1411 | 1242 | -197 | -292 | -385 | -1505 | -2086 | -1385 | 212 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 205(R) | -351 | -1687 | -179 | 891 | -1996 | -826 | 66 | -1700 | 567 | -1680 | -800 | 50 | -1394 | 1328 | | -249 | 1128 | -1307 | -1867 | -1245 | 213 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 206(L) | -2228 | -1908 | -3555 | -3373 | -604 | -3255 | -2515 | -62 | -2963 | | 358 | -3207 | -3275 | -2644 | -2802 | -2988 | -2232 | -567 | -1904 | -1643 | 214 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 207(E) | -1261 | -2925 | 1287 | ▓ | -3172 | -1326 | -611 | -3046 | -721 | -2978 | -2273 | 46 | -1812 | -271 | -1450 | -976 | -1310 | -2573 | -3131 | -2258 | 215 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 208(R) | -1403 | -2166 | -1551 | -797 | -2257 | -2051 | 2088 | -2287 | 844 | -2112 | -1431 | -830 | -2113 | 68 | ▓ | -1333 | -1230 | -2033 | -1908 | -1480 | 216 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 209(P) | -721 | -1287 | -1519 | -1649 | -2984 | 1028 | -1849 | -2874 | -1919 | -3027 | -2289 | -1426 | ▓ | -1736 | -2085 | -907 | -1079 | -2116 | -2912 | -2790 | 217 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 210(E) | -1251 | -2967 | 1669 | ▓ | -3197 | -1308 | -591 | -3075 | -714 | -2993 | -2283 | 76 | -1796 | -249 | -1463 | -958 | -1299 | -2592 | -3159 | -2259 | 218 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 211(L) | -904 | -844 | -2403 | -1784 | -342 | -2365 | -1121 | 1250 | -1186 | ▓ | 628 | -1672 | -2331 | -1162 | 772 | -1456 | -834 | 204 | -1214 | -915 | 219 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 212(Y) | -1403 | -1120 | -3032 | -2663 | 2477 | -2694 | -320 | -428 | -2317 | -519 | -196 | -1924 | -2681 | -1767 | -2127 | -1818 | -1336 | 1473 | 248 | ▓ | 220 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 213(G) | -1815 | -2026 | -2479 | -2749 | -3578 | ▓ | -2701 | -3848 | -3053 | -3865 | -3355 | -2493 | -2700 | -2875 | -2985 | -2041 | -2188 | -3149 | -3082 | -3440 | 221 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 214(V) | -1401 | -1014 | -3772 | -3281 | -840 | -3424 | -2588 | 1734 | -3048 | 1458 | 291 | -3027 | -3233 | -2685 | -2984 | -2633 | -1359 | ▓ | -2135 | -1864 | 222 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 215(N) | -1468 | -2069 | -762 | -997 | -2634 | -1768 | -1516 | -3059 | -1508 | -3127 | -2580 | ▓ | -2312 | -1391 | -1789 | -1503 | -1700 | -2572 | -2658 | -2191 | 223 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 216(P) | -1085 | -1645 | -1400 | -1250 | -2540 | -1703 | -1221 | -2412 | -640 | -2466 | -1828 | -1243 | ▓ | -987 | 539 | -1201 | -1262 | -1999 | -2445 | -2166 | 224 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 217(E) | -1877 | -2708 | -271 | ▓ | -3235 | -1868 | -1322 | -3210 | -1299 | -3203 | -2676 | -849 | -2342 | -1076 | -1736 | -1723 | -1961 | -2857 | -2976 | -2640 | 225 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 218(V) | -565 | -483 | -2432 | -1897 | 1185 | -2061 | -1097 | 692 | -1621 | -87 | 343 | -1617 | -2167 | -1361 | -1634 | -1181 | 1369 | ▓ | -1112 | -695 | 226 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 219(G) | 1216 | -738 | -1673 | -1781 | -2746 | ▓ | -1793 | -2425 | -1950 | -2725 | -1915 | -1223 | -1673 | -1686 | -2050 | -337 | -522 | -1578 | -2929 | -2677 | 227 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 220(H) | -2323 | -2419 | -1868 | -1956 | -1368 | -2396 | ▓ | -3143 | -1645 | -2924 | -2595 | -1989 | -2806 | -1873 | -1712 | -2381 | -2439 | -2923 | -1719 | -935 | 228 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 221(E) | -1877 | -2708 | -271 | ▓ | -3235 | -1868 | -1322 | -3210 | -1299 | -3203 | -2676 | -849 | -2342 | -1076 | -1736 | -1723 | -1961 | -2857 | -2976 | -2640 | 229 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 222(Q) | -600 | -1482 | -475 | -254 | -2078 | -1374 | -473 | -1739 | 63 | -1831 | -1129 | -420 | -1705 | ▓ | -202 | -619 | 958 | -1394 | -2115 | -1591 | 230 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 223(M) | -1736 | -1678 | -2975 | -2821 | -903 | -2619 | -2137 | -342 | -2336 | 24 | ▓ | -2581 | -2886 | -2281 | -2280 | -2241 | -1843 | -654 | -1928 | -1574 | 231 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 224(A) | ▓ | -600 | -1848 | -1825 | -2494 | -873 | -1680 | -2122 | -1800 | -2451 | -1642 | -1177 | -1583 | -1569 | -1896 | 972 | -376 | -1349 | -2754 | -2449 | 232 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 225(G) | -596 | -1353 | -455 | -651 | -2765 | ▓ | -1238 | -2694 | -1243 | -2817 | -2057 | 1271 | -1821 | -1009 | -1597 | -689 | -896 | -1982 | -2836 | -2358 | 233 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 226(L) | -2228 | -1908 | -3555 | -3373 | -604 | -3255 | -2515 | -62 | -2963 | ▓ | 358 | -3207 | -3275 | -2644 | -2802 | -2988 | -2232 | -567 | -1904 | -1643 | 234 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 227(N) | -1468 | -2069 | -762 | -997 | -2634 | -1768 | -1516 | -3059 | -1508 | -3127 | -2580 | ▓ | -2312 | -1391 | -1789 | -1503 | -1700 | -2572 | -2658 | -2191 | 235 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 228(F) | -2605 | -2164 | -3410 | -3518 | ▓ | -3034 | -940 | -1504 | -3300 | -1072 | -1142 | -2698 | -3246 | -2697 | -2999 | -2815 | -2670 | -1743 | -274 | 806 | 236 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 229(T) | -156 | -631 | -1441 | -1038 | -1327 | -1213 | -890 | -577 | -867 | -1099 | -449 | -889 | 1925 | -751 | -1111 | -410 | ▓ | 948 | -1720 | -1318 | 237 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 230(H) | 299 | -1594 | -259 | 23 | -1760 | -1411 | ▓ | -1605 | 285 | -1670 | -904 | -212 | -1624 | 1240 | -25 | -563 | -577 | -1296 | -1828 | -1224 | 238 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 231(G) | 1216 | -738 | -1673 | -1781 | -2746 | ▓ | -1793 | -2425 | -1950 | -2725 | -1915 | -1223 | -1673 | -1686 | -2050 | -337 | -522 | -1578 | -2929 | -2677 | 239 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 232(I) | -1412 | -1014 | -3818 | -3423 | -1244 | -3514 | -3011 | ▓ | -3223 | -139 | -82 | -3177 | -3397 | -3025 | -3258 | -2792 | -1405 | 1920 | -2622 | -2228 | 240 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |

TABLE 1-continued

HMMER2.0 [2.2g][1]  
NAME seed-short[2]  
LENG 397[3]  
ALPH Amino[4]  
MAP yes[5]  
NSEQ 21[6]  
DATE Mon Oct 19 14:08:50 2009[7]  
XT -8455 -4 -1000 -1000 -8455 -4 -8455 -4  
NULT -4 -8455[8]  
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 233(A) | ▓ | -702 | -1841 | -1506 | -1222 | -1365 | -1211 | -382 | -1249 | -749 | 1643 | -1220 | -1832 | -1146 | -1400 | -615 | -514 | -252 | -1806 | -1421 | 241 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 234(Q) | -1762 | -2287 | -1132 | -1144 | -2520 | -2040 | -1289 | -2773 | -740 | -2625 | -2183 | -1302 | -2433 | ▓ | -881 | -1765 | -1840 | -2519 | -2457 | -2076 | 242 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 235(A) | ▓ | -995 | -2154 | -2261 | -2604 | -1267 | -2060 | -2035 | -2233 | -2502 | -1934 | -1631 | -1961 | -2058 | -2240 | -724 | -871 | -1499 | -2817 | -2619 | 243 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 236(L) | -2228 | -1908 | -3555 | -3373 | -604 | -3255 | -2515 | -62 | -2963 | ▓ | 358 | -3207 | -3275 | -2644 | -2802 | -2988 | -2232 | -567 | -1904 | -1643 | 244 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 237(W) | -1283 | -1528 | 932 | -1130 | 736 | -2224 | -138 | -1253 | -1094 | -1220 | -765 | -1084 | -2321 | -868 | -1347 | -1344 | -1228 | -1158 | ▓ | 1985 | 245 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 238(A) | ▓ | -1366 | -313 | 34 | -1635 | -1335 | 1574 | -1366 | 204 | -1485 | -707 | -193 | -1544 | 1074 | -155 | -433 | -425 | -1066 | -1749 | -1178 | 246 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 239(G) | -831 | -2052 | 172 | 754 | -2493 | ▓ | -347 | -2192 | 1024 | -2191 | -1409 | -103 | -1691 | 30 | -296 | -704 | -829 | -1804 | -2375 | -1762 | 247 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 240(K) | -1892 | -2397 | -1701 | -1300 | -3050 | -2216 | -948 | -2829 | ▓ | -2696 | -2116 | -1348 | -2450 | -619 | 78 | -1865 | -1815 | -2562 | -2460 | -2321 | 248 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 241(L) | -2228 | -1908 | -3555 | -3373 | -604 | -3255 | -2515 | -62 | -2963 | ▓ | 358 | -3207 | -3275 | -2644 | -2802 | -2988 | -2232 | -567 | -1904 | -1643 | 249 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 242(F) | -2151 | -1753 | -3530 | -3327 | ▓ | -3318 | -783 | -347 | -2962 | 686 | 53 | -2548 | -3220 | -2300 | -2714 | -2589 | -2099 | -722 | -95 | 953 | 250 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 243(H) | -2323 | -2419 | -1868 | -1956 | -1368 | -2396 | ▓ | -3143 | -1645 | -2924 | -2595 | -1989 | -2806 | -1873 | -1712 | -2381 | -2439 | -2923 | -1719 | -935 | 251 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 244(I) | -1608 | -1307 | -3432 | -3238 | -1179 | -3095 | -2687 | ▓ | -2941 | -191 | -206 | -2987 | -3216 | -2818 | -2915 | -2635 | -1653 | 832 | -2363 | -1952 | 252 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 245(D) | -2059 | -2867 | ▓ | -532 | -3452 | -1877 | -1516 | -3665 | -1847 | -3616 | -3145 | -882 | -2414 | -1318 | -2469 | -1872 | -2198 | -3236 | -3167 | -2847 | 253 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 246(L) | -2228 | -1908 | -3555 | -3373 | -604 | -3255 | -2515 | -62 | -2963 | ▨ | 358 | -3207 | -3275 | -2644 | -2802 | -2988 | -2232 | -567 | -1904 | -1643 | 254 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 247(N) | -1468 | -2069 | -762 | -997 | -2634 | -1768 | -1516 | -3059 | -1508 | -3127 | -2580 | ▨ | -2312 | -1391 | -1789 | -1503 | -1700 | -2572 | -2658 | -2191 | 255 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 248(G) | -1138 | -1994 | 970 | -393 | -3114 | ▨ | -1239 | -3051 | -1406 | -3111 | -2421 | -642 | -2033 | -992 | -1944 | -1114 | -1363 | -2451 | -3025 | -2576 | 256 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 249(Q) | -1762 | -2287 | -1132 | -1144 | -2520 | -2040 | -1289 | -2773 | -740 | -2625 | -2183 | -1302 | -2433 | ▨ | -881 | -1765 | -1840 | -2519 | -2457 | -2076 | 257 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 250(R) | 494 | -1670 | -394 | 131 | -1997 | -1407 | 1541 | -1693 | 597 | -1689 | -853 | 228 | -1520 | 390 | ▨ | 1217 | -426 | -1339 | -1858 | -1299 | 258 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 251(G) | -454 | -932 | -1545 | -1368 | -1592 | ▨ | -1240 | -1146 | -1201 | -1367 | 2191 | -1171 | -1868 | -1149 | -1371 | -692 | -687 | -902 | -2003 | -1589 | 259 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 252(I) | -252 | -621 | -1011 | -601 | -831 | -1403 | -480 | ▨ | -483 | -684 | 1 | 362 | 344 | -369 | -758 | 147 | -276 | -145 | -1217 | -790 | 260 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 253(K) | -1539 | -2341 | -1845 | -864 | -3043 | -2150 | -233 | -2484 | ▨ | -2225 | -1527 | -857 | -2149 | 183 | 1839 | -1433 | -1300 | -2224 | -2127 | -1935 | 261 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 254(Y) | -2984 | -2211 | -3668 | -3802 | 2833 | -3558 | -44 | -1957 | -3405 | -1449 | -1443 | -2318 | -3461 | -2386 | -2945 | -2790 | -2877 | -2089 | 685 | ▨ | 262 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 255(D) | -2059 | -2867 | ▨ | -532 | -3452 | -1877 | -1516 | -3665 | -1847 | -3616 | -3145 | -882 | -2414 | -1318 | -2469 | -1872 | -2198 | -3236 | -3167 | -2847 | 263 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 256(Q) | -1762 | -2287 | -1132 | -1144 | -2520 | -2040 | -1289 | -2773 | -740 | -2625 | -2183 | -1302 | -2433 | ▨ | -881 | -1765 | -1840 | -2519 | -2457 | -2076 | 264 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 257(D) | -2059 | -2867 | -1132 | -532 | -3452 | -1877 | -1516 | -3665 | -1847 | -3616 | -3145 | -882 | -2414 | -1318 | -2469 | -1872 | -2198 | -3236 | -3167 | -2847 | 265 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 258(L) | -1238 | 1377 | -3271 | -2822 | -453 | -2615 | -1907 | 366 | -2410 | ▨ | 519 | -2451 | -2721 | -2079 | -2306 | -1895 | -1275 | 123 | -1577 | -1279 | 266 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 259(R) | -435 | -969 | -1119 | -575 | -1319 | -375 | -421 | -736 | 74 | -1090 | -402 | -632 | -1698 | -167 | ▓ | -601 | -453 | 1627 | -1543 | -1122 | 267 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 260(F) | -1141 | -1255 | -2377 | -2279 | ▓ | -2092 | -569 | -1041 | -2100 | -1019 | -743 | -1705 | -2446 | -1735 | -2059 | -76 | -1293 | -987 | -121 | 942 | 268 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 261(G) | -920 | -1508 | -1339 | -1295 | -2751 | ▓ | -1377 | -2630 | -937 | -2716 | -2012 | -1241 | -2085 | -1160 | 523 | -1056 | -1170 | -2071 | -2626 | -2390 | 269 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 262(H) | 910 | -1328 | -303 | 212 | -1640 | -1258 | ▓ | -1308 | 356 | -1405 | -574 | -44 | -733 | 368 | 434 | 599 | -227 | -980 | -1697 | -1118 | 270 |
| — | -102 | -6672 | -4094 | -894 | -1115 | -701 | 106 | -626 | 210 | -466 | -720 | 275 | 394 | 45 | 96 | 359 | 117 | -369 | -294 | -249 | |
| — | | | | | | | -1378 | * | * | | | | | | | | | | | | |
| 263(G) | -998 | -2008 | 156 | 1372 | -2814 | ▓ | -820 | -2621 | -763 | -2678 | -1963 | -325 | -1846 | -517 | -1251 | -919 | -1134 | -2140 | -2758 | -2201 | 271 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -22 | -6592 | -7635 | -894 | -1115 | -618 | -1521 | * | * | | | | | | | | | | | | |
| 264(D) | -896 | -2439 | ▓ | 448 | -2718 | -1275 | -358 | -2532 | -225 | -2479 | -1678 | 1424 | -1648 | 21 | 249 | -685 | -902 | -2082 | -2659 | -1868 | 272 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 265(L) | -1226 | -1270 | -2434 | -2156 | -630 | -2346 | -1635 | -84 | -1796 | ▓ | 285 | -2000 | -48 | -1683 | -1827 | -1692 | -1284 | -360 | -1630 | -1298 | 273 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 266(R) | 261 | -1516 | -309 | 264 | -1768 | -1323 | 57 | -1437 | 1161 | -420 | -634 | -7 | -1406 | 1111 | ▓ | -261 | 663 | -1102 | -1724 | -1141 | 274 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 267(A) | ▓ | -968 | -672 | -395 | -2180 | -32 | -670 | -1885 | -459 | -2014 | -1164 | 1678 | -1481 | -332 | -871 | 1019 | -328 | -1306 | -2284 | -1769 | 275 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 268(A) | ▓ | -694 | -1839 | -1891 | -2627 | 246 | -1791 | -2258 | -1948 | -2591 | -1793 | -1261 | -1663 | -1699 | -2026 | -319 | -489 | -1473 | -2840 | -2589 | 276 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 269(F) | -1633 | -1375 | -3311 | -2975 | ▓ | -2991 | -973 | 88 | -2640 | 335 | 217 | -2384 | -2965 | -2115 | -2486 | -2194 | -1612 | 560 | -373 | 594 | 277 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 270(W) | -649 | -554 | -2266 | -1731 | 1870 | -2042 | -407 | -45 | -1432 | 578 | 294 | -1386 | -2086 | -1111 | -1417 | 831 | -590 | 6 | ▓ | 661 | 278 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 271(L) | -954 | -821 | -2749 | -2189 | -379 | -2508 | -1467 | 615 | -1885 | ▓ | 848 | -1995 | -2489 | -1589 | -1889 | -1624 | 721 | 884 | -1355 | -1090 | 279 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 272(V) | -1294 | -1167 | -3176 | -3053 | -1510 | -2597 | -2599 | 776 | -2808 | -665 | -568 | -2665 | -2928 | -2721 | -2804 | -2093 | -1429 | | -2527 | -2099 | 280 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 273(D) | -2059 | -2867 | | -532 | -3452 | -1877 | -1516 | -3665 | -1847 | -3616 | -3145 | -882 | -2414 | -1318 | -2469 | -1872 | -2198 | -3236 | -3167 | -2847 | 281 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 274(L) | -2228 | -1908 | -3555 | -3373 | -604 | -3255 | -2515 | -62 | -2963 | | 358 | -3207 | -3275 | -2644 | -2802 | -2988 | -2232 | -567 | -1904 | -1643 | 282 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 275(L) | -2228 | -1908 | -3555 | -3373 | -604 | -3255 | -2515 | -62 | -2963 | | 358 | -3207 | -3275 | -2644 | -2802 | -2988 | -2232 | -567 | -1904 | -1643 | 283 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 276(E) | -1877 | -2708 | -271 | | -3235 | -1868 | -1322 | -3210 | -1299 | -3203 | -2676 | -849 | -2342 | -1076 | -1736 | -1723 | -1961 | -2857 | -2976 | -2640 | 284 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 277(N) | -343 | -1453 | -252 | 132 | -2019 | -1231 | -165 | -1718 | 264 | -1761 | -914 | | -1464 | 238 | 635 | 1541 | -137 | -1302 | -1987 | -1397 | 285 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 278(A) | | -615 | -1671 | -1548 | -2532 | 1980 | -1508 | -2242 | -1558 | -2469 | -1610 | -1047 | -1538 | -1327 | -1748 | 1152 | -334 | -1411 | -2738 | -2415 | 286 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -1061 | -6672 | -7714 | -894 | -1115 | -701 | -1378 | * | * | | | | | | | | | | | | |
| 279(F) | -62 | -382 | -969 | -612 | | 848 | -159 | -157 | -517 | -365 | 131 | -522 | -1382 | -366 | -722 | -310 | -160 | -26 | -381 | 402 | 287 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 280(P) | 53 | -411 | -890 | -673 | -945 | -1298 | -753 | -73 | -495 | -605 | -126 | -572 | | -444 | -723 | -198 | -123 | 1167 | -1421 | -973 | 288 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -43 | -5654 | -6697 | -894 | -1115 | -701 | -591 | * | * | | | | | | | | | | | | |
| 281(N) | -403 | -1803 | 1732 | 803 | -2196 | 600 | 10 | -1981 | 99 | -1980 | -1180 | | -1229 | 381 | -510 | -235 | -435 | -1535 | -2198 | -1435 | 289 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -36 | -5916 | -6958 | -894 | -1115 | -1541 | -607 | * | * | | | | | | | | | | | | |
| 282(G) | -564 | -931 | -1093 | -1247 | -2240 | | -1339 | -2241 | -1464 | -2403 | -1833 | -1104 | -1599 | -1344 | -1556 | -759 | -890 | -1685 | -2020 | -2051 | 290 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -36 | -5916 | -6958 | -894 | -1115 | -1541 | -607 | * | * | | | | | | | | | | | | |
| 283(G) | 1043 | -280 | -688 | -700 | -1858 | | -847 | -1455 | -840 | -1779 | -1026 | -438 | -1116 | -671 | -1053 | 164 | 18 | -830 | -2063 | -1703 | 291 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -36 | -5916 | -6958 | -894 | -1115 | -1541 | -607 | * | * | | | | | | | | | | | | |
| 284(P) | -290 | -1038 | -466 | -90 | -1581 | -1092 | -104 | -1283 | 527 | -1372 | -663 | -208 | | 220 | 1475 | -341 | -334 | -968 | -1564 | -1136 | 292 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -36 | -5916 | -6958 | -894 | -1115 | -349 | -2218 | * | * | | | | | | | | | | | | |

TABLE 1-continued

HMMER2.0 [2.2g]¹
NAME seed-short²
LENG 397³
ALPH Amino⁴
MAP yes⁵
NSEQ 21⁶
DATE Mon Oct 19 14:08:50 2009⁷
XT −8455 −4 −1000 −1000 −8455 −4 −8455 −4
NULT −4 −8455⁸
NULE 595 −1588 85 338 −294 453 −1158 197 249 902 −1085 −142 −21 −313 45 531 201 384 −1998 −644⁹

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 285(G) | 638 | −1161 | −471 | −124 | −2022 | ▨ | −396 | −1704 | 1009 | −1808 | −971 | −280 | −1477 | −27 | −463 | 540 | −339 | −1238 | −2076 | −1532 | 293 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 286(Y) | −2887 | −2205 | −3496 | −3544 | 1333 | −3432 | −88 | −2037 | −3047 | −1553 | −1514 | −2272 | −3386 | −2288 | −2715 | −2719 | −2795 | −2134 | 1494 | ▨ | 294 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 287(D) | 192 | −1858 | ▨ | 1374 | −2155 | −1216 | 15 | −1908 | 361 | −1866 | −969 | 151 | −1383 | 1382 | −169 | −23 | 260 | −1470 | −2052 | −1350 | 295 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 288(G) | −1815 | −2026 | −2479 | −2749 | −3578 | ▨ | −2701 | −3848 | −3053 | −3865 | −3355 | −2493 | −2700 | −2875 | −2985 | −2041 | −2188 | −3149 | −3082 | −3440 | 296 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 289(P) | −2089 | −2190 | −2567 | −2787 | −3372 | −2253 | −2663 | −3607 | −2895 | −3590 | −3215 | −2612 | ▨ | −2846 | −2839 | −2316 | −2418 | −3135 | −2975 | −3234 | 297 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 290(R) | −1641 | −2275 | −1933 | −1088 | −2932 | −2175 | −424 | −2500 | 1015 | −2295 | −1649 | −1042 | −2256 | −38 | ▨ | −1586 | −1455 | −2254 | −2181 | −1996 | 298 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 291(H) | −2323 | −2419 | −1868 | −1956 | −1368 | −2396 | ▨ | −3143 | −1645 | −2924 | −2595 | −1989 | −2806 | −1873 | −1712 | −2381 | −2439 | −2923 | −1719 | −935 | 299 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 292(F) | −2605 | −2164 | −3410 | −3518 | 2734 | −3034 | −940 | −1504 | −3300 | −1072 | −1142 | −2698 | −3246 | −2697 | −2999 | −2815 | −2670 | −1743 | −274 | 806 | 300 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 293(D) | −2059 | −2867 | ▨ | −532 | −3452 | −1877 | −1516 | −3665 | −1847 | −3616 | −3145 | −882 | −2414 | −1318 | −2469 | −1872 | −2198 | −3236 | −3167 | −2847 | 301 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 294(Y) | 579 | −1160 | −1868 | −2299 | −1368 | −2531 | −229 | −710 | −2012 | −758 | −361 | −1718 | −2573 | −1556 | −1937 | −1652 | −1288 | −684 | 285 | ▨ | 302 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 295(K) | −1225 | −2178 | −1024 | −471 | −2433 | −1882 | 2092 | −2276 | ▨ | −2116 | −1390 | −596 | −1974 | 157 | 713 | −1121 | −1075 | −1982 | −2013 | −1586 | 303 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 296(P) | 1158 | −816 | −1549 | −1568 | −2492 | −1042 | −1594 | −2082 | −1610 | −2398 | −1676 | −1163 | ▨ | −1455 | −1757 | −417 | −570 | −1432 | −2710 | −2399 | 304 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 297(P) | −197 | −804 | −966 | −577 | −1355 | −1206 | −599 | −964 | −444 | 231 | −508 | −598 | ▨ | −375 | −760 | 1626 | −323 | −681 | −1668 | −1194 | 305 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 298(R) | -2176 | -2415 | -2504 | -1923 | -3054 | -2403 | -1269 | -3053 | -167 | -2856 | -2350 | -1844 | -2662 | -997 | ▨ | -2228 | -2131 | -2807 | -2501 | -2452 | 306 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 299(T) | -665 | -1148 | -2040 | -2098 | -2442 | -1424 | -1936 | -1850 | -1956 | -2305 | -1815 | -1645 | -2071 | -1911 | -2001 | -909 | ▨ | -1444 | -2672 | -2426 | 307 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 300(E) | -1251 | -2967 | 1669 | ▨ | -3197 | -1308 | -591 | -3075 | -714 | -2993 | -2283 | 76 | -1796 | -249 | -1463 | -958 | -1299 | -2592 | -3159 | -2259 | 308 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 301(D) | -1120 | -2685 | ▨ | 438 | -3120 | 658 | -599 | -2993 | -733 | -2934 | -2207 | 768 | -1759 | -261 | -1478 | -875 | -1202 | -2475 | -3126 | -2235 | 309 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 302(F) | -407 | -383 | -1904 | 346 | ▨ | -1828 | -478 | 1038 | -1078 | 161 | 475 | -1148 | -1876 | -826 | -1146 | -877 | -346 | 230 | -488 | 1761 | 310 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 303(D) | -981 | -2590 | ▨ | 1382 | -2857 | -1262 | -422 | -2656 | -403 | -2615 | -1835 | 116 | -1677 | -53 | -1074 | -746 | 483 | -2200 | -2827 | -1988 | 311 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 304(G) | 439 | -855 | -1581 | -1757 | -2835 | ▨ | -1850 | -2546 | -2010 | -2843 | -2063 | -1269 | -1756 | -1754 | -2106 | -457 | -649 | -1703 | -2977 | -2743 | 312 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 305(V) | -1294 | -1167 | -3176 | -3053 | -1510 | -2597 | -2599 | 776 | -2808 | -665 | -568 | -2665 | -2928 | -2721 | -2804 | -2093 | -1429 | ▨ | -2527 | -2099 | 313 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 306(W) | -3232 | -2594 | -3508 | -3648 | -882 | -2917 | -1886 | -3060 | -3237 | -2665 | -2615 | -3229 | -3282 | -3161 | -2996 | -3457 | -3341 | -3103 | ▨ | -495 | 314 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 307(A) | ▨ | -1986 | 1345 | 1356 | -2294 | -1231 | -146 | -2041 | 102 | -2030 | -1173 | 114 | -356 | 265 | -456 | -410 | -533 | -1618 | -2244 | -1527 | 315 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 308(S) | -447 | -881 | -1613 | -1364 | 1517 | -1419 | -806 | -1058 | -1261 | -1223 | -705 | -1119 | -1875 | -1080 | -1446 | ▨ | -648 | -827 | -983 | -113 | 316 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 309(A) | ▨ | -995 | -2154 | -2261 | -2604 | -1267 | -2060 | -2035 | -2233 | -2502 | -1934 | -1631 | -1961 | -2058 | -2240 | -724 | -871 | -1499 | -2817 | -2619 | 317 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |
| 310(K) | 1246 | -1752 | -354 | 687 | -2095 | -1400 | 24 | -1767 | ▨ | -1730 | -874 | -63 | -1490 | 459 | 1177 | -382 | -400 | -1394 | -1891 | -1325 | 318 |
|  | -149 | -500 | 233 | 43 | -381 | 399 | 106 | -626 | 210 | -466 | -720 | 275 | 394 | 45 | 96 | 359 | 117 | -369 | -294 | -249 |  |
|  | -21 | -6672 | -7714 | -894 | -1115 | -701 | -1378 | * | * |  |  |  |  |  |  |  |  |  |  |  |  |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 311(G) | 1279 | -1129 | 455 | -229 | -2280 | ▓▓ | -665 | -1991 | -519 | -2113 | -1277 | -355 | -1522 | -330 | -976 | 392 | -436 | -1424 | -2385 | -1830 | 319 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 312(C) | -342 | ▓▓ | -1550 | -1431 | -1885 | -1211 | -1326 | -1596 | -1300 | -1974 | -1287 | 2515 | -1793 | -1235 | -1463 | -561 | -633 | -1160 | -2187 | -1732 | 320 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 313(M) | -1538 | -1273 | -3473 | -2967 | -378 | -3209 | -2177 | 1411 | -2583 | 795 | ▓▓ | -2776 | -3045 | -2211 | -2502 | -2413 | -1492 | 381 | -1708 | -1493 | 321 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 314(R) | -802 | -1573 | -1236 | -713 | -2404 | -1580 | -468 | -2096 | 486 | -2079 | -1343 | -728 | -1867 | -105 | ▓▓ | 691 | -850 | -1698 | -2130 | -1757 | 322 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 315(M) | -291 | -866 | -751 | -323 | -1102 | -1363 | -365 | -625 | -175 | -903 | ▓▓ | 1884 | -1580 | -129 | -510 | -445 | 862 | -433 | -1424 | -950 | 323 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 316(Y) | -2742 | -2290 | -3014 | -3139 | 701 | -3008 | -615 | -2258 | -2836 | -1879 | -1835 | -2399 | -3220 | -2421 | -2640 | -2733 | -2781 | -2314 | 18 | ▓▓ | 324 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 317(L) | -2228 | -1908 | -3555 | -3373 | -604 | -3255 | -2515 | -62 | -2963 | ▓▓ | 358 | -3207 | -3275 | -2644 | -2802 | -2988 | -2232 | -567 | -1904 | -1643 | 325 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 318(I) | -1718 | -1320 | -3950 | -3454 | -500 | -3658 | -2657 | ▓▓ | -3157 | 1891 | 635 | -3261 | -3346 | -2650 | -3014 | -2895 | -1657 | 685 | -1967 | -1796 | 326 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 319(L) | -2228 | -1908 | -3555 | -3373 | -604 | -3255 | -2515 | -62 | -2963 | ▓▓ | 358 | -3207 | -3275 | -2644 | -2802 | -2988 | -2232 | -567 | -1904 | -1643 | 327 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 320(K) | -1892 | -2397 | -1701 | -1300 | -3050 | -2216 | -948 | -2829 | ▓▓ | -2696 | -2116 | -1348 | -2450 | -619 | 78 | -1865 | -1815 | -2562 | -2460 | -2321 | 328 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 321(E) | -1027 | -2709 | 1389 | ▓▓ | -2938 | -1270 | -422 | -2771 | -394 | -2690 | -1910 | 126 | -1688 | 847 | -1061 | -772 | -1042 | -2301 | -2880 | -2022 | 329 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 322(R) | -1262 | -1929 | -1576 | -1005 | -2676 | -1901 | -641 | -2373 | 404 | -2286 | -1610 | -1018 | 104 | -286 | ▓▓ | -1282 | -1246 | -2043 | -2243 | -1991 | 330 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 323(A) | ▓▓ | -817 | -1288 | -964 | -1935 | -1111 | -906 | -1465 | -558 | -1746 | -1009 | -813 | -1616 | -662 | 368 | -363 | -64 | -1031 | -2134 | -1737 | 331 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 324(Q) | 921 | -1531 | -150 | 983 | -1783 | -1243 | 90 | -1481 | 984 | -362 | -643 | 89 | -373 | ▓ | 16 | -170 | -191 | -1116 | -1755 | -1125 | 332 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 325(A) | ▓ | -721 | -1722 | -1692 | -2428 | -988 | -1617 | -2000 | -1677 | -2335 | -1590 | -1188 | 277 | -1495 | -1805 | -343 | -489 | -1343 | -2672 | -2372 | 333 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 326(F) | -1141 | -1255 | -2377 | -2279 | -2483 | -2092 | -569 | -1041 | -2100 | -1019 | -743 | -1705 | -2446 | -1735 | -2059 | -76 | -1293 | -987 | -121 | 942 | 334 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 327(R) | 26 | -1636 | -1533 | -952 | -2483 | -1704 | -566 | -2043 | 472 | -2068 | -1404 | -909 | -1989 | -212 | ▓ | -1021 | -1002 | -1707 | -2177 | -1875 | 335 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 328(A) | ▓ | -1366 | -122 | 1071 | -2009 | -1198 | -396 | -1654 | -158 | -1799 | -1003 | -190 | -81 | -44 | -610 | -402 | -477 | -1263 | -2110 | -1531 | 336 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 329(D) | -1040 | -2279 | ▓ | 219 | -2914 | -1294 | -744 | -2643 | -860 | -2773 | -2097 | -113 | -1811 | -431 | -1522 | -889 | 170 | -2183 | -2988 | -2215 | 337 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 330(P) | -1078 | -1646 | -1388 | -1222 | -2530 | -1702 | -1185 | -2393 | -586 | -2444 | -1802 | -1219 | ▓ | -944 | 631 | -1190 | -1247 | -1984 | -2429 | -2146 | 338 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 331(E) | -592 | -2098 | 820 | ▓ | -2389 | -1258 | -116 | -2150 | 202 | -2093 | -1225 | 119 | -1495 | 1056 | 383 | -427 | -554 | -1711 | -2269 | -1550 | 339 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 332(V) | -864 | 1397 | -3270 | -2925 | -1287 | -2333 | -2263 | 1008 | -2628 | -532 | -284 | -2379 | -2649 | -2425 | -2605 | -1626 | -986 | ▓ | -2235 | -1829 | 340 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 333(Q) | -1116 | -2159 | -1088 | -390 | -2695 | -1853 | -132 | -2237 | 1638 | -2059 | -1295 | -519 | -1896 | ▓ | 1253 | -1004 | -949 | -1924 | -2060 | -1716 | 341 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 334(E) | 77 | -1884 | 74 | ▓ | -2260 | -1329 | -186 | -1946 | 248 | -1959 | -1140 | -36 | -1567 | 216 | 517 | -508 | -594 | -1564 | -2165 | -1539 | 342 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 335(A) | ▓ | -778 | -1188 | -678 | -992 | -1464 | -510 | -448 | -265 | 351 | -128 | -707 | -1690 | -333 | 310 | -572 | -378 | -302 | -1373 | -946 | 343 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |
| 336(L) | -273 | -1147 | -3152 | -2607 | -269 | -2901 | -1837 | 473 | -2264 | ▓ | 1696 | -2426 | -2787 | -1885 | -2206 | -2051 | -1280 | 127 | -1497 | -1323 | 344 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -21 | -6672 | -7714 | -894 | -1115 | -701 | -1378 | * | * | | | | | | | | | | | | |

TABLE 1-continued

HMMER2.0 [2.2g]¹
NAME seed-short²
LENG 397³
ALPH Amino⁴
MAP yes⁵
NSEQ 21⁶
DATE Mon Oct 19 14:08:50 2009⁷
XT -8455 -4 -1000 -1000 -8455 -4 -8455 -4
NULT -4 -8455⁸
NULE 595 -1588 85 338 -294 453 -1158 197 249 902 -1085 -142 -21 -313 45 531 201 384 -1998 -644⁹

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 337(A) | ▨ | -1532 | -474 | 87 | -1918 | -1382 | -46 | -1567 | 1215 | -1601 | -772 | -145 | -1504 | 365 | 1342 | 125 | -380 | -1223 | -1818 | -1283 | 345 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 338(A) | ▨ | -972 | -614 | 294 | -1776 | -1148 | -611 | -1301 | -417 | -1587 | -829 | -465 | -1555 | -323 | -786 | -354 | 962 | -937 | -1990 | -1503 | 346 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 339(S) | 1294 | -832 | -756 | -278 | -1210 | -1235 | -345 | -856 | -177 | -1085 | -331 | -396 | -201 | -85 | -555 | ▨ | -227 | -590 | -1486 | 1213 | 347 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 340(R) | -570 | -1686 | -582 | 34 | -1977 | 144 | -15 | -1637 | 1580 | -1635 | -817 | -192 | -157 | 4399 | ▨ | -500 | -474 | -1317 | -1803 | 1086 | 348 |
| | -149 | -500 | 233 | 43 | -381 | 399 | 106 | -626 | 210 | -466 | -720 | 275 | 394 | 46 | 96 | 359 | 117 | -369 | -294 | -249 | |
| | -307 | -2420 | -7714 | -894 | -1115 | -701 | -1378 | * | * | | | | | | | | | | | | |
| 341(V) | -336 | -353 | -1746 | -266 | -2570 | -1760 | -562 | 286 | -906 | 1013 | 531 | -1061 | -1812 | -710 | -1015 | -805 | -277 | ▨ | 1260 | -385 | 350 |
| | -149 | -500 | 233 | 340 | -254 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 342(D) | 352 | -1357 | ▨ | 274 | 527 | -1272 | -34 | -1207 | 263 | -1335 | -525 | -5 | -1411 | 741 | -215 | -270 | 262 | -916 | -1662 | -1069 | 351 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 343(E) | -521 | -1935 | 227 | ▨ | -2246 | -1250 | -100 | -1987 | 223 | -1965 | -1102 | 97 | 607 | 1057 | -287 | 155 | -487 | -1568 | -2166 | -1473 | 352 |
| | -149 | -500 | 233 | 43 | -381 | 399 | 106 | -626 | 210 | ▨ | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 344(L) | 546 | -413 | -2480 | -1879 | -125 | -2068 | -906 | 1031 | -1548 | ▨ | 714 | -1574 | -2081 | -1226 | -1484 | -1149 | -484 | 382 | 1382 | -472 | 353 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 345(A) | ▨ | -1490 | 227 | 381 | -1734 | 4 | 86 | -1428 | 735 | -1476 | -609 | 88 | -377 | 512 | 391 | -161 | -178 | -1072 | -1730 | -134 | 354 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 346(Q) | -254 | -1503 | -183 | 1017 | -1748 | -1253 | 86 | -1438 | 495 | -297 | -617 | 73 | -1345 | ▨ | 735 | 190 | 977 | -1084 | -1731 | -1110 | 355 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 347(P) | 421 | -948 | -865 | -458 | -1802 | -1152 | -548 | -1416 | -196 | -1606 | -823 | -506 | ▨ | -237 | 384 | -316 | 452 | -1015 | -1949 | -1485 | 356 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 348(T) | -276 | -686 | -1314 | -885 | -1018 | -1380 | -716 | -410 | -659 | 414 | -163 | -836 | -135 | -591 | -897 | -537 | ▨ | -256 | -1462 | -1045 | 357 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 349(L) | 1151 | -788 | -2503 | -1952 | -325 | -2317 | -1281 | 427 | -1656 | ▨ | 1590 | -1784 | -2340 | -1385 | -1690 | -1427 | -817 | 257 | -1248 | -972 | 358 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |

TABLE 1-continued

```
HMMER2.0 [2.2g]¹
NAME seed-short²
LENG 397³
ALPH Amino⁴
MAP yes⁵
NSEQ 21⁶
DATE Mon Oct 19 14:08:50 2009⁷
XT -8455 -4 -1000 -1000 -8455 -4 -8455 -4
NULT -4 -8455⁸
NULE 595 -1588 85 338 -294 453 -1158 197 249 902 -1085 -142 -21 -313 45 531 201 384 -1998 -644⁹
```

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 350(N) | 1068 | -1985 | 832 | 927 | -2287 | 217 | -111 | -2043 | 157 | -2016 | -1147 | ▓▓▓ | -1465 | 308 | -398 | -378 | -498 | -1611 | -2219 | -1499 | 359 |
| — | -149 | -500 | 233 | -381 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 351(D) | 515 | -2116 | ▓▓▓ | 1040 | -2419 | -1237 | -204 | -2180 | 1 | -2157 | -1311 | 118 | 1413 | 200 | -577 | -479 | -630 | -1746 | -2368 | -1626 | 360 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -214 | -6672 | -2965 | -894 | -1115 | -701 | -1378 | * | * | | | | | | | | | | | | |
| 352(G) | -1483 | -1738 | -2118 | -2361 | -3240 | ▓▓▓ | -2356 | -3437 | -2647 | -3497 | -2968 | -2132 | -2414 | -2483 | -2624 | -1701 | -1847 | -2772 | -2817 | -3088 | 361 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -602 | -6482 | -1599 | -894 | -1115 | -1010 | -990 | * | * | | | | | | | | | | | | |
| 353(E) | -844 | -1778 | 472 | ▓▓▓ | -2144 | -1088 | -364 | -1914 | -199 | -2018 | -1432 | 9 | -1504 | -76 | -613 | -726 | -895 | -1616 | -2068 | -1590 | 362 |
| — | -149 | -500 | 233 | -381 | -381 | 399 | 106 | -626 | 210 | -466 | -720 | 275 | 394 | 45 | 96 | 359 | 117 | -369 | -294 | -249 | |
| — | -36 | -5916 | -6958 | -894 | -1115 | -1541 | -607 | * | * | | | | | | | | | | | | |
| 354(S) | 409 | -277 | -676 | -434 | -1615 | 472 | -531 | -1263 | -415 | -1493 | -687 | -281 | -1062 | -284 | -715 | ▓▓▓ | 1521 | -699 | -1824 | -1402 | 363 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -36 | -5916 | -6958 | -894 | -1115 | -349 | -2218 | * | * | | | | | | | | | | | | |
| 355(Y) | 176 | -326 | -1853 | -1280 | -211 | -1746 | -587 | 276 | -1009 | 1143 | 525 | -1118 | -1820 | -790 | -1087 | -806 | 334 | 460 | -736 | ▓▓▓ | 364 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 356(Q) | 1158 | -1744 | 813 | 939 | -2039 | -1215 | 47 | -1776 | 411 | -1756 | -861 | 138 | -1359 | ▓▓▓ | -105 | 600 | -85 | -1356 | -1956 | -1275 | 365 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 357(D) | 1036 | -1772 | ▓▓▓ | 823 | -2060 | -1224 | 1065 | -1797 | 408 | -1774 | -882 | 135 | -1370 | 477 | 479 | -226 | -297 | -1379 | -1971 | -1290 | 366 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 358(L) | -831 | -865 | -1889 | 480 | -453 | -2235 | -1046 | 1057 | -1158 | ▓▓▓ | 523 | -1421 | -2241 | -1015 | -1320 | -1316 | -771 | 284 | -1297 | -968 | 367 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 359(L) | -837 | -924 | -1941 | -1334 | -448 | -2177 | -874 | 129 | 765 | ▓▓▓ | 1446 | -1328 | -2171 | -793 | -816 | -1251 | -762 | -40 | -1238 | -923 | 368 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -1143 | -485 | * | * | | | | | | | | | | | | |
| 360(A) | ▓▓▓ | -1304 | 264 | -12 | -2084 | -1143 | -485 | -1768 | -315 | -1902 | -1096 | 676 | -568 | -145 | -788 | -383 | -481 | -1328 | -2203 | -1621 | 369 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -1311 | -657 | * | * | | | | | | | | | | | | |
| 361(D) | -1360 | -3141 | ▓▓▓ | 1479 | -3350 | -1311 | -657 | -3259 | -874 | -3165 | -2499 | 78 | -1836 | -330 | -1688 | -1038 | -1426 | -2762 | -3331 | -2380 | 370 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |
| 362(R) | 1110 | -1178 | -914 | -425 | -2040 | -1274 | -431 | -1667 | 185 | -1776 | -982 | -495 | -1601 | -75 | ▓▓▓ | 266 | -459 | -1250 | -2016 | -1566 | 371 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6672 | -7714 | -894 | -1115 | -701 | -1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 363(S) | 660 | -658 | -1132 | -653 | -1190 | -1207 | -583 | -715 | -506 | 248 | -310 | -639 | -1546 | -394 | -817 | | 985 | -458 | -1520 | -1091 | 372 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 364(A) | | -1109 | -599 | -215 | -1913 | -1164 | -412 | -1560 | 1070 | -1701 | -888 | -346 | -1504 | -60 | -397 | 906 | -348 | -1138 | -1994 | -1480 | 373 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 365(F) | -1666 | -1475 | -2647 | -2273 | -2529 | -2733 | -126 | -1109 | -1832 | -1025 | -680 | -1722 | -2730 | -1513 | 985 | -1846 | -1589 | -1094 | 401 | 2740 | 374 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 366(E) | 1231 | -2217 | 1090 | | -2662 | -1247 | -283 | -2286 | -130 | -2276 | -1451 | 104 | -1579 | 108 | -726 | -564 | -741 | -1853 | -2493 | -1734 | 375 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | | | -1115 | -701 | -1378 | * | * | | | | | | | | | | | | |
| 367(D) | -807 | -2381 | | 1701 | -2662 | -153 | -299 | -2456 | -176 | -2404 | -1577 | 131 | -1595 | 93 | -801 | -602 | 340 | -1999 | -2603 | -1807 | 376 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 368(F) | -2122 | -1662 | -3439 | -3251 | | -3201 | -250 | -937 | -2878 | 738 | -472 | -2219 | -3110 | -2117 | -2574 | -2364 | -2033 | -1127 | 427 | 2382 | 377 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 369(D) | -106 | -2081 | | 302 | -2719 | -1222 | -536 | -2478 | -516 | -2518 | -1742 | -21 | 945 | -185 | -1136 | -670 | -895 | -1991 | -2748 | -1995 | 378 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 370(V) | 1420 | -434 | -1909 | -1374 | -548 | -1743 | -830 | 417 | -1135 | 567 | 297 | -1213 | -880 | -938 | -1254 | -846 | -374 | | -1093 | -720 | 379 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 371(D) | -1069 | -2768 | | 2120 | -3007 | -1268 | -462 | -2850 | -491 | -2770 | -2001 | 126 | -238 | -97 | -1197 | -805 | -1095 | -2370 | -2962 | -2084 | 380 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 372(A) | | -1018 | -521 | 219 | -2069 | -1094 | -793 | -1676 | -652 | -1914 | -1144 | -512 | -1591 | -518 | -1012 | 194 | -479 | -1214 | -2262 | -1772 | 381 |
| | -149 | -500 | 233 | -894 | -381 | 399 | 106 | -626 | 210 | -466 | -720 | 275 | 394 | 45 | 96 | 359 | 117 | -369 | -294 | -248 | |
| | -21 | -3423 | -7714 | -422 | -1979 | -1512 | -336 | -123 | 725 | -487 | 179 | -589 | -1619 | -212 | -602 | -527 | -227 | 695 | -1054 | -619 | |
| 373(A) | | -605 | -1051 | -501 | 555 | | -79 | -1628 | 270 | -1677 | -820 | -589 | -1619 | -212 | -602 | -527 | -227 | 695 | -1054 | -619 | 383 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 374(A) | | -1501 | 684 | 281 | -1928 | 64 | -1378 | -1628 | 270 | -1677 | 179 | 6 | -1408 | 332 | 916 | -249 | -300 | -1233 | -1925 | -1300 | 384 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |
| 375(A) | | -1589 | -193 | 665 | -1851 | -1305 | 1059 | -1534 | 504 | -1565 | -713 | 20 | -1412 | 946 | 607 | -274 | -289 | -1184 | -1797 | -1195 | 385 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -21 | -6672 | -7714 | | -1115 | -701 | -1378 | * | * | | | | | | | | | | | | |

TABLE 1-continued

HMMER2.0 [2.2g]<sup>1</sup>
NAME seed-short<sup>2</sup>
LENG 397<sup>3</sup>
ALPH Amino<sup>4</sup>
MAP yes<sup>5</sup>
NSEQ 21<sup>6</sup>
DATE Mon Oct 19 14:08:50 2009<sup>7</sup>
XT −8455 −4 −1000 −1000 −8455 −4 −8455 −4
NULT −4 −8455<sup>8</sup>
NULE 595 −1588 85 338 −294 453 −1158 197 249 902 −1085 −142 −21 −313 45 531 201 384 −1998 −644<sup>9</sup>

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 376(R) | −1614 | −2370 | −2014 | −948 | −3100 | −2204 | −239 | −2515 | 2045 | −2241 | −1554 | −910 | −2189 | 176 | ▒ | −1510 | −1356 | −2268 | −2131 | −1966 | 386 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −45 | −6672 | −5593 | −894 | −1115 | −701 | −1378 | * | * | | | | | | | | | | | | |
| 377(G) | −227 | −995 | −514 | −621 | −2598 | ▒ | −1104 | −2383 | −1085 | −2534 | −1712 | 700 | −1597 | −848 | −1442 | 475 | −540 | −1636 | −2744 | −2250 | 387 |
| — | −149 | −500 | 233 | 43 | −381 | 399 | 106 | −626 | 210 | −466 | −719 | 275 | 394 | 45 | 96 | 359 | 117 | −369 | −294 | −249 | |
| — | −1813 | −3952 | −620 | −1278 | −767 | −674 | −1422 | * | * | | | | | | | | | | | | |
| 378(T) | 788 | −14 | −411 | −289 | −946 | −373 | −321 | 3 | −144 | −602 | −96 | −129 | −912 | −138 | −343 | 312 | ▒ | 256 | −1367 | −928 | 391 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −380 | −2195 | −6258 | −462 | −1868 | −273 | −2536 | * | * | | | | | | | | | | | | |
| 379(M) | −645 | −509 | −2405 | −1863 | 2203 | −2065 | −400 | −15 | −1534 | −240 | ▒ | −1445 | −2099 | −1182 | −142 | −1141 | −581 | 44 | 674 | 2154 | 393 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 380(A) | ▒ | −667 | −1488 | −1343 | −2399 | 1353 | −1365 | −2084 | −1366 | −2315 | −1480 | −970 | 504 | −1166 | −1595 | −208 | −355 | −1350 | −2606 | −2254 | 394 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 381(F) | −157 | −954 | −2834 | −2359 | ▒ | −2528 | −1072 | 238 | −2050 | 1087 | 505 | −2003 | −2540 | −1667 | −1985 | −1670 | −1066 | 47 | −705 | 20 | 395 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 382(E) | −328 | −925 | −616 | ▒ | −1062 | −545 | −254 | 284 | −67 | −820 | −134 | −349 | −1576 | 14 | −460 | −466 | −286 | 1263 | −1383 | −892 | 396 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 383(R) | −570 | −1882 | 277 | 160 | −2259 | −1451 | 1440 | −1932 | 1247 | −1846 | −988 | −96 | −1537 | 644 | ▒ | −453 | −477 | −1542 | −1960 | −1408 | 397 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 384(L) | −1018 | −1162 | −2165 | −1980 | −936 | −207 | −1526 | −403 | −1702 | ▒ | −157 | −1778 | −2350 | −1618 | −1747 | −1407 | −1137 | −503 | −1693 | −1309 | 398 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 385(D) | −977 | −2554 | ▒ | 464 | −2883 | −1256 | −450 | −2718 | −443 | −2663 | −1882 | 2380 | −2 | −85 | −1116 | −749 | −1012 | −2239 | −2855 | −2014 | 399 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 386(Q) | −923 | −1831 | −422 | −324 | −1528 | −1528 | −632 | −2219 | −101 | −2202 | −1511 | −528 | 80 | ▒ | −359 | −896 | −984 | −1846 | −2304 | −1794 | 400 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 387(L) | −124 | −1187 | −2771 | −2463 | −2362 | −2463 | −1870 | 292 | −2101 | ▒ | 475 | −2214 | −2644 | −1894 | −2088 | −1750 | −1260 | 31 | −1713 | −1435 | 401 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |
| 388(A) | ▒ | −694 | −1839 | −1891 | −2627 | 246 | −1791 | −2258 | −1948 | −2591 | −1793 | −1261 | −1663 | −1699 | −2026 | −319 | −489 | −1473 | −2840 | −2589 | 402 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6672 | −7714 | −894 | −1115 | −701 | −1378 | * | * | | | | | | | | | | | | |

TABLE 1-continued

HMMER2.0 [2.2g][1]
NAME seed-short[2]
LENG 397[3]
ALPH Amino[4]
MAP yes[5]
NSEQ 21[6]
DATE Mon Oct 19 14:08:50 2009[7]
XT -8455 -4 -1000 -1000 -8455 -4 -8455 -4
NULT -4 -8455[8]
NULE 595 -1588 85 338 -294 453 -1158 197 249 902 -1085 -142 -21 -313 45 531 201 384 -1998 -644[9]

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 389(M) | -586 | -422 | -2607 | -2005 | -236 | -2162 | -1033 | 1738 | -1674 | 727 | ▓ | -1686 | -2164 | -1351 | -269 | -1247 | -526 | 1278 | -937 | -619 | 403 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 390(E) | -86 | -2659 | 2289 | ▓ | -2918 | -1261 | -428 | -2735 | -423 | -2675 | -1894 | 125 | -1682 | -59 | -1107 | -758 | -1026 | -2265 | -2876 | -2019 | 404 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 391(H) | -1063 | -1596 | -1226 | -723 | 125 | -1986 | ▓ | -1400 | -6 | -1381 | -808 | -779 | -2060 | -275 | 584 | -1076 | -975 | -1242 | -421 | 1920 | 405 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 392(L) | -2228 | -1908 | -3555 | -3373 | -604 | -3255 | -2515 | -62 | -2963 | ▓ | 358 | -3207 | -3275 | -2644 | -2802 | -2988 | -2232 | -567 | -1904 | -1643 | 406 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 393(L) | -1311 | -1120 | -3138 | -2575 | -246 | -2891 | -1784 | 463 | -2223 | ▓ | 1961 | -2395 | -2763 | -1847 | -2162 | -2028 | -31 | 113 | -1452 | -1278 | 407 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 394(G) | -290 | -847 | -1769 | -1799 | -2291 | ▓ | -1705 | -1729 | -1796 | -2216 | -1592 | -1322 | -1804 | -1637 | -1895 | -526 | -654 | 179 | -2597 | -2248 | 408 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 395(A) | ▓ | -539 | -1889 | -1592 | -1657 | -1048 | -1298 | -901 | -1422 | -1478 | -795 | -1130 | -1629 | -1231 | -1567 | 446 | -331 | 1000 | -2050 | -1697 | 409 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -21 | -6672 | -7714 | -894 | -1115 | -701 | -1378 | * | * | | | | | | | | | | | | |
| 396(R) | -1262 | -1929 | -1576 | -1005 | -2676 | -1901 | -641 | -2373 | 404 | -2286 | -1610 | -1018 | 104 | -286 | ▓ | -1282 | -1246 | -2043 | -2243 | -1991 | 410 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -30 | -6155 | -7197 | -894 | -1115 | -701 | -1378 | * | * | | | | | | | | | | | | |
| 397(G) | 21 | -791 | -381 | -92 | -1740 | ▓ | -286 | -1423 | 81 | -1560 | -757 | -172 | -1269 | 42 | 694 | 855 | -134 | -959 | -1829 | -1336 | 411 |
| | * | * | * | * | * | * | * | * | * | * | * | * | * | * | * | * | * | * | * | * | |
| | | | | | | | | | 0 | | | | | | | | | | | | |

[1]Program name and version
[2]Name of the input sequence alignment file
[3]Length of the alignment: include indels
[4]Type of residues
[5]Map of the match states to the columns of the alignment
[6]Number of sequences in the alignment
[7]When the file was generated
[8]The transition probability distribution for the null model (single G state).
[9]The symbol emission probability distribution for the null model (G tate); consists of K integers. The null probability used to convert these back to model probabilities is 1/K.

TABLE 2

E-values and XI Group membership for proteins by SEQ ID NO.

| Organism | SEQ ID NO: Amino acid | GI or AC # | XI Group | E-value |
|---|---|---|---|---|
| Streptomyces ambofaciens | 16 | 126348424 | I | 0 |
| Streptomyces sp. | 20 | 38141596 | I | 0 |
| Streptomyces coelicolor | 32 | Q9L0B8 | I | 0 |
| Streptomyces avermitilis | 34 | Q93HF3 | I | 0 |
| Streptomyces violaceusniger | 68 | P09033 | I | 0 |
| Streptomyces olivaceoviridis | 96 | Q93RJ9 | I | 0 |
| Streptomyces corchorusii | 106 | Q9S3Z4 | I | 0 |
| Streptomyces thermocyaneoviolaceus | 108 | Q9L558 | I | 0 |
| Streptomyces diastaticus | 122 | P50910 | I | 0 |
| Streptomyces rubiginosus | 128 | P24300 | I | 0 |
| Streptomyces murinus | 130 | P37031 | I | 0 |
| Streptomyces olivochromogenes | 135 | P15587 | I | 0 |
| Streptomyces olivochromogenes | 136 | 157879319 | I | 0 |
| Streptomyces olivochromogenes | 138 | 157881044 | I | 0 |
| Streptomyces diastaticus | 139 | 7766813 | I | 0 |
| Streptomyces albus | 142 | P24299 | I | 0 |
| Streptomyces diastaticus | 144 | 9256915 | I | 0 |
| Streptomyces rubiginosus | 146 | 21730246 | I | 0 |
| Streptomyces pristinaespiralis | 48 | 197776540 | I | 1.00E−305 |
| Actinoplanes missouriensis | 66 | P12851 | I | 2.70E−305 |
| Actinoplanes missouriensis | 140 | 349936 | I | 1.30E−302 |
| Streptomyces sp. | 46 | 197764953 | I | 2.90E−302 |
| Clavibacter michiganensis | 42 | A5CPC1 | I | 4.30E−302 |
| Actinoplanes missouriensis | 134 | 443486 | I | 7.80E−302 |
| Actinoplanes missouriensis | 147 | 443568 | I | 7.80E−302 |
| Clavibacter michiganensis | 2 | B0RIF1 | I | 1.40E−301 |
| Actinoplanes sp. | 24 | P10654 | I | 2.10E−301 |
| Arthrobacter sp. | 126 | A0JXN9 | I | 2.30E−301 |
| Actinoplanes missouriensis | 145 | 443526 | I | 2.30E−301 |
| Actinoplanes missouriensis | 143 | 443303 | I | 4.00E−301 |
| Arthrobacter sp. | 54 | P12070 | I | 3.50E−298 |
| Arthrobacter aurescens | 90 | 119964059 | I | 1.10E−297 |
| Micromonospora sp. | 112 | 237882534 | I | 2.00E−297 |
| Arthrobacter chlorophenolicus | 4 | 220912923 | I | 3.30E−296 |
| Arthrobacter sp. | 133 | 231103 | I | 3.20E−294 |
| Arthrobacter sp. | 141 | 2914276 | I | 1.10E−293 |
| Arthrobacter sp. | 12 | 60615686 | I | 8.70E−293 |
| Acidothermus cellulolyticus | 30 | 117929271 | I | 3.50E−292 |
| Streptomyces griseus | 118 | 182434863 | I | 1.50E−291 |
| Salinispora arenicola | 18 | 159039501 | I | 8.10E−289 |
| Geodermatophilus obscures | 64 | 227404617 | I | 1.80E−286 |
| Catenulispora acidiphila | 104 | 229246901 | I | 5.60E−286 |
| Salinispora tropica | 44 | 145596104 | I | 1.80E−282 |
| marine actinobacterium | 110 | 88856315 | I | 8.10E−282 |
| Mycobacterium smegmatis | 10 | 118469437 | I | 5.30E−281 |
| Saccharomonospora viridis | 76 | 229886404 | I | 3.40E−278 |
| Streptomyces rochei | 137 | P22857 | I | 3.40E−275 |
| Mycobacterium vanbaalenii | 120 | 120406242 | I | 7.00E−274 |
| Streptomyces lividans | 78 | Q9RFM4 | I | 1.70E−272 |
| Thermus thermophilus | 100 | P26997 | I | 4.80E−272 |
| Nakamurella multipartita | 38 | 229221673 | I | 1.00E−271 |
| Thermos caldophilus | 131 | 4930285 | I | 1.90E−269 |
| Thermus caldophilus | 132 | P56681 | I | 2.70E−269 |
| Streptosporangium roseum | 82 | 229851079 | I | 1.90E−264 |
| Beutenbergia cavernae | 62 | 229821786 | I | 9.10E−262 |
| Cellulomonas flavigena | 74 | 229243977 | I | 1.10E−261 |
| Kribbella flavida | 8 | 227382478 | I | 4.80E−261 |
| Thermobifida fusca | 114 | 72162004 | I | 5.90E−261 |
| Janibacter sp. | 58 | 84495191 | I | 1.40E−259 |
| Nocardiopsis dassonvillei | 36 | 229207664 | I | 1.80E−258 |
| Actinosynnema mirum | 6 | 226865307 | I | 4.70E−257 |
| Nocardioides sp. | 84 | 119716602 | I | 6.40E−256 |
| Actinomyces urogenitalis | 14 | 227497116 | I | 3.70E−250 |
| Meiothermus ruber | 52 | 227992647 | I | 1.40E−245 |
| Brachybacterium faecium | 60 | 237671435 | I | 3.10E−245 |
| Jonesia denitrificans | 94 | 227383768 | I | 1.60E−244 |
| Kribbella flavida | 86 | 227381155 | I | 3.80E−244 |
| Frankia sp. | 80 | 158316430 | I | 2.50E−242 |
| Actinomyces odontolyticus | 70 | 154508186 | I | 8.80E−239 |
| Meiothermus silvanus | 22 | 227989553 | I | 1.90E−229 |
| Leifsonia xyli | 92 | 50954171 | I | 2.50E−226 |
| Mobiluncus curtisii | 26 | 227493823 | I | 2.50E−225 |
| Mobiluncus mulieris | 72 | 227875705 | I | 9.70E−225 |
| Deinococcus geothermalis | 124 | 94972159 | I | 1.80E−224 |
| Stackebrandtia nassauensis | 98 | 229862570 | I | 9.40E−224 |
| Roseiflexus sp. | 50 | 148656997 | I | 5.10E−223 |
| Thermobaculum terrenum | 56 | 227374836 | I | 5.60E−222 |
| Roseiflexus castenholzii | 88 | 156742580 | I | 3.10E−221 |
| Herpetosiphon aurantiacus | 28 | 159898286 | I | 1.10E−204 |
| Xylanimonas cellulosilytica | 40 | 227427650 | I | 1.90E−204 |
| Herpetosiphon aurantiacus | 116 | 159897776 | I | 8.70E−203 |
| Acidobacteria bacterium | 102 | 94967932 | I | 2.20E−181 |
| Geobacillus kaustophilus | 305 | Q5KYS6 | II | 1.50E−07 |
| Geobacillus thermodenitrificans | 195 | A4IP67 | II | 3.80E−06 |
| Tetragenococcus halophilus | 180 | O82845 | II | 0.00028 |
| Bacillus licheniformis | 237 | P77832 | II | 0.00036 |
| Mesorhizobium sp. | 250 | Q11EH9 | II | 0.00085 |
| Bacillus subtilis | 220 | P04788 | II | 0.0038 |
| Thermotoga maritima | 207 | Q9X1Z5 | II | 0.0049 |
| Thermotoga sp. | 227 | B1LB08 | II | 0.0049 |
| Bacillus amyloliquefaciens | 212 | A7Z522 | II | 0.012 |
| Thermotoga petrophila | 268 | A5ILR5 | II | 0.03 |
| Bacillus sp. | 260 | P54272 | II | 0.041 |
| Bifidobacterium longum | 175 | B3DR33 | II | 0.068 |
| Geobacillus stearothermophilus | 238 | P54273 | II | 0.072 |
| Bacillus megaterium | 214 | O08325 | II | 0.28 |
| Bacillus cereus | 228 | Q739D2 | II | 0.46 |
| Thermotoga neapolitana | 232 | P45687 | II | 1.1 |
| Fervidobacterium gondwanense | 246 | Q6T6K9 | II | 1.5 |
| Bacillus halodurans | 277 | Q9K993 | II | 1.7 |
| Lactobacillus pentosus | 269 | P21938 | II | 1.8 |
| Staphylococcus xylosus | 206 | P27157 | II | 2.5 |

TABLE 2-continued

E-values and XI Group membership for proteins by SEQ ID NO.

| Organism | SEQ ID NO: Amino acid | GI or AC # | XI Group | E-value |
|---|---|---|---|---|
| Bifidobacterium adolescentis | 205 | A1A0H0 | II | 3.9 |
| Bacillus clausii | 278 | Q5WKJ3 | II | 4.2 |
| Bifidobacterium longum | 161 | Q8G3Q1 | II | 11 |
| Lactococcus lactis | 270 | Q9CFG7 | II | 15 |
| Bacillus pumilus | 296 | A8FE33 | II | 21 |
| Thermoanaerobacterium saccharolyticum | 284 | P30435 | II | 62 |
| Thermoanaerobacterium thermosulfurigenes | 267 | P19148 | II | 75 |
| Thermoanaerobacter pseudethanolicus | 176 | P22842 | II | 1.10E+02 |
| Thermoanaerobacter sp. | 172 | B0K1L3 | II | 1.40E+02 |
| Rhizobium leguminosarum | 240 | Q1MBL8 | II | 2.40E+02 |
| Thermoanaerobacterium thermosaccharolyticum | 257 | P29441 | II | 2.90E+02 |
| Lactobacillus brevis | 263 | P29443 | II | 3.00E+02 |
| Lactobacillus brevis | 274 | Q03TX3 | II | 3.20E+02 |
| Listeria welshimeri | 303 | A0AF79 | II | 3.50E+02 |
| Bacteroides thetaiotaomicron | 196 | Q8A9M2 | II | 3.90E+02 |
| Thermoanaerobacter yonseiensis | 304 | Q9KGU2 | II | 4.10E+02 |
| Rhizobium etli | 290 | Q2K433 | II | 4.20E+02 |
| Salmonella enterica | 148 | B4T952 | II | 4.30E+02 |
| Klebsiella pneumoniae | 149 | P29442 | II | 4.30E+02 |
| Sinorhizobium meliloti | 150 | Q92LW9 | II | 4.30E+02 |
| Escherichia coli | 151 | Q7A9X4 | II | 4.30E+02 |
| Salmonella enterica | 152 | Q5PLM6 | II | 4.30E+02 |
| Xanthomonas campestris | 153 | Q3BMF2 | II | 4.30E+02 |
| Pectobacterium atrosepticum | 154 | Q6DB05 | II | 4.30E+02 |
| Rhodopirellula baltica | 155 | Q7UVG2 | II | 4.30E+02 |
| Xanthomonas axonopodis | 156 | Q8PEW5 | II | 4.30E+02 |
| Xanthomonas oryzae | 157 | Q5GUF2 | II | 4.30E+02 |
| Pediococcus pentosaceus | 158 | Q03HN1 | II | 4.30E+02 |
| Brucella suis | 159 | Q8G204 | II | 4.30E+02 |
| Escherichia coli | 160 | Q0TBN7 | II | 4.30E+02 |
| Brucella canis | 162 | A9M9H3 | II | 4.30E+02 |
| Burkholderia multivorans | 163 | A9ARG7 | II | 4.30E+02 |
| Brucella ovis | 164 | A5VPA1 | II | 4.30E+02 |
| Rhizobium etli | 165 | B3Q0R5 | II | 4.30E+02 |
| Burkholderia xenovorans | 166 | Q13RB8 | II | 4.30E+02 |
| Actinobacillus pleuropneumoniae | 167 | A3N3K2 | II | 4.30E+02 |
| Burkholderia cenocepacia | 168 | B4ENA5 | II | 4.30E+02 |
| Solibacter usilatus | 169 | Q022S9 | II | 4.30E+02 |
| Brucella abortus | 170 | B2SA37 | II | 4.30E+02 |
| Rhodobacter sphaeroides | 171 | A4WVT8 | II | 4.30E+02 |
| Yersinia pseudotuberculosis | 173 | Q1C0D3 | II | 4.30E+02 |
| Xanthomonas oryzae | 174 | Q5GYQ7 | II | 4.30E+02 |
| Photobacterium profundum | 177 | Q6LUY7 | II | 4.30E+02 |
| Escherichia coli | 178 | B1LJC7 | II | 4.30E+02 |
| Agrobacterium tumefaciens | 179 | Q8U7G6 | II | 4.30E+02 |
| Salmonella enterica | 181 | B4TZ55 | II | 4.30E+02 |
| Yersinia pseudotuberculosis | 182 | Q8Z9Z1 | II | 4.30E+02 |
| Yersinia pseudotuberculosis | 183 | Q1CDB8 | II | 4.30E+02 |
| Rhodobacter sphaeroides | 184 | A3PNM4 | II | 4.30E+02 |
| Brucella abortus | 185 | Q2YMQ2 | II | 4.30E+02 |
| Salmonella enterica | 186 | Q8ZL90 | II | 4.30E+02 |
| Bacteroides vulgatus | 187 | A6L792 | II | 4.30E+02 |
| Xanthomonas axonopodis | 188 | Q8PLL9 | II | 4.30E+02 |
| Salmonella enterica | 189 | Q57IG0 | II | 4.30E+02 |
| Escherichia coli | 190 | B7M3I8 | II | 4.30E+02 |
| Roseobacter denitrificans | 191 | Q162B6 | II | 4.30E+02 |
| Bacteroides fragilis | 192 | Q64U20 | II | 4.30E+02 |
| Enterobacter sakazakii | 193 | A7MNI5 | II | 4.30E+02 |
| Brucella abortus | 194 | Q57EI4 | II | 4.30E+02 |
| Haemophilus influenzae | 197 | A5UCZ3 | II | 4.30E+02 |
| Yersinia pseudotuberculosis | 198 | B2K7D2 | II | 4.30E+02 |
| Xanthomonas campestris | 199 | Q4UTU6 | II | 4.30E+02 |
| Haemophilus somnus | 200 | B0UT19 | II | 4.30E+02 |
| Pseudoalteromonas atlantica | 201 | Q15PG0 | II | 4.30E+02 |
| Escherichia fergusonii | 202 | B7LTH9 | II | 4.30E+02 |
| Silicibacter sp. | 203 | Q1GKQ4 | II | 4.30E+02 |
| Salmonella enterica | 204 | B5R4P8 | II | 4.30E+02 |
| Salmonella enterica | 208 | A9MUV0 | II | 4.30E+02 |
| Pseudomonas syringae | 209 | Q48J73 | II | 4.30E+02 |
| Shigella boydii | 210 | Q31V53 | II | 4.30E+02 |
| Burkholderia ambifaria | 211 | Q0B1U7 | II | 4.30E+02 |
| Haemophilus influenzae | 213 | A5UIN7 | II | 4.30E+02 |
| Arabidopsis thaliana | 215 | Q9FKK7 | II | 4.30E+02 |
| Escherichia coli | 216 | Q3YVV0 | II | 4.30E+02 |
| Bacteroides fragilis | 217 | Q5LCV9 | II | 4.30E+02 |
| Pseudomonas fluorescens | 218 | Q3KDW0 | II | 4.30E+02 |
| Escherichia coli | 219 | B1X8I1 | II | 4.30E+02 |
| Xanthomonas campestris | 221 | Q4UNZ4 | II | 4.30E+02 |
| Pseudomonas syringae | 222 | Q4ZSF5 | II | 4.30E+02 |
| Sinorhizobium medicae | 223 | A6UD89 | II | 4.30E+02 |
| Ochrobactrum anthropi | 224 | A6X4G3 | II | 4.30E+02 |
| Burkholderia thailandensis | 225 | Q2SW40 | II | 4.30E+02 |
| Salmonella enterica | 226 | B5EX72 | II | 4.30E+02 |
| Salmonella enterica | 229 | B4SWK9 | II | 4.30E+02 |
| Salmonella enterica | 230 | Q7C637 | II | 4.30E+02 |
| Enterococcus faecalis | 231 | Q7C3R3 | II | 4.30E+02 |
| Escherichia coli | 233 | B7MES1 | II | 4.30E+02 |
| Photorhabdus luminescens | 234 | Q7N4P7 | II | 4.30E+02 |
| Enterobacter sp. | 235 | A4W566 | II | 4.30E+02 |
| Burkholderia cenocepacia | 236 | B1KB47 | II | 4.30E+02 |
| Brucella abortus | 239 | Q8YFX5 | II | 4.30E+02 |
| Yersinia enterocolitica | 241 | A1JT10 | II | 4.30E+02 |
| Serratia proteamaculans | 242 | A8G7W8 | II | 4.30E+02 |
| Yersinia pseudotuberculosis | 243 | A7FP68 | II | 4.30E+02 |
| Escherichia coli | 244 | B7NEL7 | II | 4.30E+02 |
| Yersinia pestis | 245 | A9R5Q1 | II | 4.30E+02 |
| Xanthomonas campestris | 247 | Q8P3H1 | II | 4.30E+02 |
| Rhizobium leguminosarum | 248 | B5ZQV6 | II | 4.30E+02 |
| Bradyrhizobium japonicum | 249 | Q89VC7 | II | 4.30E+02 |
| Actinobacillus pleuropneumoniae | 251 | B3H2X9 | II | 4.30E+02 |
| Yersinia pseudotuberculosis | 252 | Q663Y3 | II | 4.30E+02 |
| Xanthomonas campestris | 253 | Q8P9T9 | II | 4.30E+02 |
| Burkholderia cenocepacia | 254 | A0KE56 | II | 4.30E+02 |
| Oceanobacillus iheyensis | 255 | Q8ELU7 | II | 4.30E+02 |
| Brucella suis | 256 | B0CKM9 | II | 4.30E+02 |
| Burkholderia phymatum | 258 | B2JFE9 | II | 4.30E+02 |
| Yersinia pseudotuberculosis | 259 | B1JH40 | II | 4.30E+02 |
| Lactococcus lactis | 261 | Q02Y75 | II | 4.30E+02 |
| Novosphingobium aromaticivorans | 262 | Q2GAB9 | II | 4.30E+02 |
| Mesorhizobium loti | 264 | Q98CR8 | II | 4.30E+02 |
| Escherichia coli | 265 | A8A623 | II | 4.30E+02 |
| Burkholderia | 266 | Q1BG90 | II | 4.30E+02 |

TABLE 2-continued

E-values and XI Group membership for proteins by SEQ ID NO.

| Organism | SEQ ID NO: Amino acid | GI or AC # | XI Group | E-value |
|---|---|---|---|---|
| cenocepacia | | | | |
| Ruminococcus flavefaciens | 271 | Q9S306 | II | 4.30E+02 |
| Burkholderia phytofirmans | 272 | B2T929 | II | 4.30E+02 |
| Salmonella enterica | 273 | B5FLD6 | II | 4.30E+02 |
| Burkholderia ambifaria | 275 | B1Z405 | II | 4.30E+02 |
| Salmonella enterica | 276 | B5RGL6 | II | 4.30E+02 |
| Marinomonas sp. | 279 | A6VWH1 | II | 4.30E+02 |
| Yersinia pseudotuberculosis | 280 | A4TS63 | II | 4.30E+02 |
| Actinobacillus pleuropneumoniae | 281 | B0BTI9 | II | 4.30E+02 |
| Silicibacter pomeroyi | 282 | Q5LV46 | II | 4.30E+02 |
| Xanthomonas oryzae | 283 | Q2NXR2 | II | 4.30E+02 |
| Escherichia coli | 285 | B6I3D6 | II | 4.30E+02 |
| Escherichia coli | 286 | B5YVL8 | II | 4.30E+02 |
| Escherichia coli | 287 | B7NP65 | II | 4.30E+02 |
| Escherichia coli | 288 | B2U560 | II | 4.30E+02 |
| Escherichia coli | 289 | B1IZM7 | II | 4.30E+02 |
| Escherichia coli | 291 | P00944 | II | 4.30E+02 |
| Hordeum vulgare | 292 | Q40082 | II | 4.30E+02 |
| Dinoroseobacter shibae | 293 | A8LP53 | II | 4.30E+02 |
| Rhodobacter sphaeroides | 294 | Q3IYM4 | II | 4.30E+02 |
| Actinobacillus succinogenes | 295 | A6VLM8 | II | 4.30E+02 |
| Escherichia coli | 297 | Q8FCE3 | II | 4.30E+02 |
| Pseudomonas syringae | 298 | Q880Z4 | II | 4.30E+02 |
| Burkholderia vietnamiensis | 299 | A4JSU5 | II | 4.30E+02 |
| Escherichia coli | 300 | A7ZTB2 | II | 4.30E+02 |
| Haemophilus influenzae | 301 | P44398 | II | 4.30E+02 |
| Haemophilus influenzae | 302 | Q4QLI2 | II | 4.30E+02 |
| Mannheimia succiniciproducens | 306 | Q65PY0 | II | 4.30E+02 |

SEQUENCE LISTING (345 sequences)

SEQ ID NO: 1 - DNA, 1194 bp, Clavibacter michiganensis
atggcgctcacccccacccgcgaggacaagttctcgttcggactctggaccatcggatacacgggggccgatcccttcggcggccccacccgctccgacctcgacgtggtcgagggcgtcgagcgcatctcggagctgggcgcctacggcctcaccttccacgacgacgacctcttcgcgttcggatccaccgacgccgagcgccagacgcagatcgaccgcctcaagggtgcgctcagcgacaccggcatcgtcgtgccgatggtcaccacgaacctcttctccgcgcccgtcttcaaggacggcggcttcacctcgaacgaccgcgccgtccgccggttcgcgatccgcaaggtgctccgcaacatcgatctcgccgctgagctcggcgcgaagacgttcgtcatgtggggcggccgcgagggcgccgagtacgactccgcgaaggacgtccgcggcgcgctcgagcgctaccgcgaggccgtcaacctgctcggcgactacgtcaccgacaagggctacgacatccgcttcgcgatcgagccgaagcccaacgagccccgcggcgacatcctgctgcccaccctcggccacgcgctcgcgttcatcgagaccctcgagcgccccgagctcgtcggcgtgaaccccgaggtcggccacgagcagatggcgggcctcaacttcaccgccggcatcatgcaggcgctgtaccagggcaagctgttccacatcgacctcaacggccagcgcggcatcaagtacgaccaggacctcgtcttcggccacggcgacctgcagaacgcgttctcgctcgtcgacctgctggagaacggcggcgtgggcggcggccgctcctacgacggcccgcgccacttcgactacaagcccagccgcaccgaggacatcacgggcgtgtgggactccgccgccgcgaacatgcgcatgtacctgctcctcaaggagcgcgcgcaggcgttccgcgccgaccccgaggttcaggaggcgctcgccgccgctaaggtcgccgagatcgacaccccgacgctcaacgagggcgagtcctacgacgacatcctcgcggaccgctcctcgtacgaggacttcgcggccgacgagtacttcgacgcgaagggcttcggcttcgtccgcctcaaccagctggcgctcgagcacctgatgggcgcgcgctcctag

SEQ ID NO: 2 - protein, 397 aa, Clavibacter michiganensis
MALTPTREDKFSFGLWTIGYTGADPFGGPTRSDLDVVEGVERISELGAYGLTFHDDDLFAFGSTDAERQTQIDRLKGALSDTGIVVPMVTTNLFSAPVFKDGGFTSNDRAVRRFAIRKVLRNIDLAAELGAKTFVMWGGREGAEYDSAKDVRGALERYREAVNLLGDYVTDKGYDIRFAIEPKPNEPRGDILLPTLGHALAFIETLERPELVGVNPEVGHEQMAGLNFTAGIMQALYQGKLFHIDLNGQRGIKYDQDLVFGHGDLQNAFSLVDLLENGGVGGGRSYDGPRHFDYKPSRTEDITGVWDSAAANMRMYLLLKERAQAFRADPEVQEALAAAKVAEIDTPTLNEGESYDDILADRSSYEDFAADEYFDAKGFGFVRLNQLALEHLMGARS

SEQ ID NO: 3 - DNA, 1188 bp, Arthrobacter chlorophenolicus
atgactctctcccccaccactgccgacaagttcacctttggcctctggacggtgggctggaccggcgcggacccgttcggtgtagccacccgcgcggcgcttgacccggtggaagccgtccataaactcagcgaactgggcgcctacggcatcactttccacgacaacgacctggttcccttcgatgcccccgcctccgagcgcgaactgatcctcaagaacttccgcgcagccctggcagacaccgggctcaaggtgccgatggtcaccaccaacctcttcagccacccggtcttcaaggacggcggcttcacctccaacgaccgctccgtgcgccggttcgccctgtccaaggtgctccgcaacatcgacctcgccgcagaactcggcgccgaaaccttcgtcatgtggggcggccgcgaaggcagcgaatacgacggctccaaagacctcgctgcagcgctggaccgcatgaaggaaggcgtggacaccgccgccggctacatcaaggacaagggctacaacctgcgcatcgccctcgagcccaagcccaacgaaccccgcggtgacatcttcctgcccaccgtcggacacggcctggcattcatcgcccagctcgaacacggcgacatcgtgggcctgaaccccgaaaccggccacgaacaaatggccggactgaacttcacccacggcatcgcccaggcactctgggcaggcaagctgttccacatcgacctcaacgggcagcgcggcatcaagtacgaccaggacctcgtcttcggccacggcgacctcaccagcgccttcttcaccgtcgacctcctcgaaaacggcttcccgggaggcggaccgaagtacgacggcccccgccacttcgactacaagccctcccgcaccgacggctacgacggcgtctgggaatccgccaaggccaacatggccatgtacctgctgctgaaggaacgggcactggccttccgcgccgaccccgaagtccaggaagccctggcagcgtcaggcgtcttcgaactcggcgaacccaccctcaacgccggcgaaaccaccgccgacctgctcgcggacgccgcatcctttgaagacttcgacgccgacaaggccgccgaacgctccttcgccttcgtccggctcaaccagctcgccatcgaacacctcctcaacgcccgctga

SEQ ID NO: 4 - protein, 395 aa, Arthrobacter chlorophenolicus
MTLSPTTADKFTFGLWTVGWTGADPFGVATRAALDPVEAVHKLSELGAYGITFHDNDLVPFDAPASERELILKNFRAALADTGLKVPMVTTNLFSHPVFKDGGFTSNDRSVRRFALSKVLRNIDLAAELGAETFVMWGGREGSEYDGSKDLAAALDRMKEGVDTAAGYIKDKGYNLRIALEPKPNEPRGDIFLPTVGHGLAFIAQLEHGDIVGLNPETGHEQMAGLNFTHGIAQALWAGKLFHIDLNGQRGIKYDQDLVFGHGDLTSAFFTVDLLENGFPGGGPKYDGPRHFDYKPSRTDGYDGVWESAKANMAMYLLLKERALAFRADPEVQEALAASGVFELGEPTLNAGETTADLLADAASFEDFDADKAAERSFAFVRLNQLAIEHLLNAR

SEQ ID NO: 5 - DNA, 1140 bp, Actinosynnema mirum
gtgaccgacttcagcttcggcctgtggacggttggctggcaggggcgtgacccgttcggggacgccacccggcccgtcctcgacgcgccaacggcggtgcgcaagctcgccgagctgggcgcctggggcgtcaccttccacgacgacgacctgatccccttcggggccggcgccgccgagcgggaccggcgggtctccgcgttccgcggcgcgctcgacgagaccgggctcgtcgtgccgatggtgaccacgaacctgttcacccaccccgtcttcaaggacggcggcttcaccagcaacgaccggtcggtgcgccggttcgcgctgcgcaaggtgctgcgcaacctggagctcgccgccgagctcggcgccaagacgatcgtcctgtggggcggtcgcgagggctccgagacggacgcgggcaaggacgtgcaggccgccctggagcggtaccgcgaggcgctggacacggtcgcgcagcactccgtcgaccagggctacggcttccggttcgcgctggagcccaagcccaacgagccgcgcggcgacatcctgctgccgaccgtcgggcacgcgctcgcgttcatctccaccctccagcaccacgagctggtcggcgtgaaccccgaggtcggccacgagcagatggccaacctgaacttcgtccacggcatcgcgcaggcgctgtggcagaagaagctgttccacatcgacctcaacgggcagaaggggccgcgcttcgaccaggacctggtcttcggccacggcgacctgctctcggcgttcttcctggtcgacctcctggagaacggcggctacgacggcccccgccacttcgactacaagccgctgcgcaccgaggacgtcgacggcgtgtgggacagcgccgccgccaacatgcgcacctacaccctcctcaaggagcgcgcgcaggcctaccgcgccgaccccgaggtgcaggaggcgctgcgggtcagcggcgtcaccgagcaggccgtgcccaccctcggcgagggcgagtcgatcgcggacttcctcgcggccgacgagtcgttcgaccccgacaaggccgccgagcgcgggtacgggttcgtgaagctgtcgcagctggccctcgagcacctcctgggcgcccgctga

SEQ ID NO: 6 - protein, 379 aa, Actinosynnema mirum
MTDFSFGLWTVGWQGRDPFGDATRPVLDAPTAVRKLAELGAWGVTFHDDDLIPFGAGAAERDRRVSAFRGALDETGLVVPMVTTNLFTHPVFKDGGFTSNDRSVRRFALRKVLRNLELAAELGAKTIVLWGGREGSETDAGKDVQAALERYREALDTVAQHSVDQGYGFRFALEPKPNEPRGDILLPTVGHALAFISTLQHHELVGVNPEVGHEQMANLNFVHGIAQALWQKKLFHIDLNGQKGPRFDQDLVFGHGDLLSAFFLVDLLENGGYDGPRHFDYKPLRTEDVDGVWDSAAANMRTYTLLKERAQAYRADPEVQEALRVSGVTEQAVPTLGEGESIADFLAADESFDPDKAAERGYGFVKLSQLALEHLLGAR

SEQ ID NO: 7 - DNA, 1167 bp, Kribbella flavida
atgaccgatgccgacttcatgcccacccgcgaggacaagttctcgttcggtctgtggacggtcggctggcagggcgtcgacgtgttcggcggcgaggtccgcccggtgctcgacccggcgcaggccgtgcacaagctgagcgagctcggcgcctacggcatcacctttcacgacaacgacgtgtttccgttcggcagctcggccgccgaccgcgacgcccacctgaagccgttccgggccgcgctggaggaaaccgggctcaaggtcccgatggtgaccacgaatctgttctcccacccggtcttccgcgacggcggcttcaccaacaacgaccgcgacgtacgccggtacgcgatccgcaagaccgccgaccagctcgacctggccgccgagctcggcgccgagaccttcgtcgcctggggcggccgggaaggcgccgagtccggggccgccaaggacgtgcgggccgcgctcgaccggtacaaggaggccttcgacatcctcggcgcgtacgcggccgagcagggctacgacatccggttcgcgatcgagcccaagccgaacgagccgcgcggcgacattctgctgccgacgatcgggcacgccctggccttcatcgagacgctggagtactccgagcgggtcggtctcaacccggaggtcgggcacgaggagatggccgggctcaactacgcgcacggcatcgcccaggcgctgtggcacggcaagctcttccacgccgacctgaacgggcagaacggtccgcgctacgaccaggacctgcggttcggcgccggcaacgcgcgcggggccttctggacggtcgacgtgctcgagcacggcgggtacgacggtccgcggcacttcgacttcaagccgccgcgcaccgaggacctggacggggtctgggcgtcggccgcgggctgcatgcgcaactacctgatcctgcgcgccaaggtccgcgccttccgcgccgaccccgaggtgcagcaggcactgcgcgacgcccggctcgaccagctcgcccagccgacggtggcggccggcgaaaccgtcgccacgctacgcgccgaggacttcgaccccgacgaggccggacgccgcgggatggccttcgagcagctcgaccagctcgcgatcgagcacctctacggcacgaggtcctga

SEQ ID NO: 8 - protein, 388 aa, Kribbella flavida
MTDADFMPTREDKFSFGLWTVGWQGVDVFGGEVRPVLDPAQAVHKLSELGAYGITFHDNDVFPFGSSAADRDAHLKPFRAALEETGLKVPMVTTNLFSHPVFRDGGFTNNDRDVRRYAIRKTADQLDLAAELGAETFVAWGGREGAESGAAKDVRAALDRYKEAFDILGAYAAEQGYDIRFAIEPKPNEPRGDILLPTIGHALAFIETLEYSERVGLNPEVGHEEMAGLNYAHGIAQALWHGKLFHADLNGQNGPRYDQDLRFGAGNARGAFWTVDVLEHGGYDGPRHFDFKPPRTEDLDGVWASAAGCMRNYLILRAKVRAFRADPEVQQALRDARLDQLAQPTVAAGETVATLRAEDFDPDEAGRRGMAFEQLDQLAIEHLYGTRS

SEQ ID NO: 9 - DNA, 1224 bp, Mycobacterium smegmatis
atgaccgtgttggagtcgaacgtctccacaaccgaaccgctcaccccgaagcgagaggaccgtttctcgttcggcctctggaccatcggctggaacggaaacgatccgttcggcgtcgccacccgcccggcgctcgacgtcgtggaggccgtcgagaaactggccgaactcggcgcgtacgggctgacgttccacgatgacgacctgttcgcgttcggcagttccgacaccgagcggcggcggatggtcgaccggttgacgtcggcgttgtcggccaacggcatggtggtcccgatggtgacgaccaacctgttcacccagcccgtcttcaaggacggcggtttcaccagcaacgaccgcacggtgcggcgtttcgcgctgcgcaaggtgctgcgcaacatcgatttggccatcgaactcggcgccgagaccttcgtgttgtggggcggccgtgagggcagcgaatacgactcggccaaggacgtgcaggccgcgctggcgcgctaccgcgaagcgatggatctgttgtgccagtacgtgatcgaccagggcagcgggttgcgcttcgcgatcgaacccaaacccaacgagccgcgcggcgacatcctgctgcccacggtggggcacgcgctggcattcatcgacaccctggcccgcccggagatggtcggggtgaaccccgagaccggccacgagcagatgtccggcctgaacttcatgcacggcatcgcacaggccctgtacagcggcaagctcttccacatcgacctcaacggtcagcggggcatcaagttcgaccaggacctcgtgttcgggcacggcgacctggccaatgccttcgcgctcgtggatctgctcgaacacggtggtcccgacggcaccccggcgtacgagggtcctcggcacttcgactacaagcccagccgcaccgaggacatcgacggtgtgtgggcctcggcggccgcgaacatgcggatgtacctgctgctcaagcagcgcgccgaggcgttccgcgccgatcccgcggtgcgtgaggcgatggcggcggccaaggtggccgaattgcggcagccgacgctcgcgccgggcgagacgtaccacgacctgttggccgaccgctcggccttcgaggagttcgacagtgaggcctatttcggcggcaagggttgcggtttcgtcgcattgcagcagttggccatcgaacacctgatgggcgcgcgatga

SEQ ID NO: 10 - protein, 407 aa, Mycobacterium smegmatis
MTVLESNVSTTEPLTPKREDRFSFGLWTIGWNGNDPFGVATRPALDVVEAVEKLAELGAYGLTFHDDDLFAFGSSDTERRRMVDRLTSALSANGMVVPMVTTNLFTQPVFKDGGFTSNDRTVRRFALRKVLRNIDLAIELGAETFVLWGGREGSEYDSAKDVQAALARYREAMDLLCQYVIDQGSGLRFAIEPKPNEPRGDILLPTVGHALAFIDTLARPEMVGVNPETGHEQMSGLNFMHGIAQALYSGKLFHIDLNGQRGIKFDQDLVFGHGDLANAFALVDLLEHGGPDGTPAYEGPRHFDYKPSRTEDIDGVWASAAANMRMYLLLKQRAEAFRADPAVREAMAAAKVAELRQPTLAPGETYHDLLADRSAFEEFDSEAYFGGKGCGFVALQQLAIEHLMGAR

SEQ ID NO: 11 - DNA, 1188 bp, Arthrobacter sp.
atgactcttcagccaacccccgccgaccgcttcacttttggattgtggaccgtgggatggaccggcgccgatccgttcggcgtcgccacccgcgagaacctggatccggtggaagctgtgcacaagctggccgagctcggcgcctacggcatcaccttccacgacaacgacctggttcccttcgacgccaccgaggcggaacgtgaacaggtccttgcaggcttccgcacggcgctggaggaaaccgggttgaaggtcccgatggtgaccaccaacctgttcagccacccggtgttcaaggacggcggcttcacctccaacgaccgctcgatccgccgcttcgcgctggccaaggtgctgcacaacatcgatcttgctgccgagatgggcgccgagaccttcgtcaagtggggcggccgcgaaggctccgagtacgacggctccaaggatctggccgcggcgctggaccgcatgcgcgaaggcgtggacaccgctgccggctacatcaaggaaaaaggctacaacctgcgcatcgcgctggagccaaagccgaatgagccgcgcggcgacattttcctgcccaccgtgggccacggactggccttcatcgagcagctggagcacggcgacatcgtcggcctgaacccagaaaccggccacgagcagatggccggcctgaacttcacccacggcatcgcccaggcgctgtgggcaggcaagctgttccatatcgagctcaacggccagcggggcatcaagtacgaccaggacctggtcttcggccacggcgacctggccagcgccttcttcaccgtggacctgctggaaaacggcttcccgaacggcggaccaaagtacgacggcccgcgccacttcgactacaagccatcacgcaccgacggctacgacggggtctgggactcggccaaggccaacatgtccatgtacctgatgctcaaggaacgcgcacaggcattccgcgccgaccccgaggtacaggaggcaatgaagctctcgggcgtgttcgagctgggcgagagcaccctggatgccggcgagagtgcgcagcaactgatggacgatgcggctagcttcgccggcttcgacgccaacgccgcagcgcagcgcaacttcgcattcatccgcctgaaccagctggccatcgagcacctgctgggcgcccgctga

SEQ ID NO: 12 - protein, 395 aa, Arthrobacter sp.
MTLQPTPADRFTFGLWTVGWTGADPFGVATRENLDPVEAVHKLAELGAYGITFHDNDLVPFDATEAEREQVLAGFRTALEETGLKVPMVTTNLFSHPVFKDGGFTSNDRSIRRFALAKVLHNIDLAAEMGAETFVKWGGREGSEYDGSKDLAAALDRMREGVDTAAGYIKEKGYNLRIALEPKPNEPRGDIFLPTVGHGLAFIEQLEHGDIVGLNPETGHEQMAGLNFTHGIAQALWAGKLFHIELNGQRGIKYDQDLVFGHGDLASAFFTVDLLENGFPNGGPKYDGPRHFDYKPSRTDGYDGVWDSAKANMSMYLMLKERAQAFRADPEVQEAMKLSGVFELGESTLDAGESAQQLMDDAASFAGFDANAAAQRNFAFIRLNQLAIEHLLGAR

SEQ ID NO: 13 - DNA, 1212 bp, Actinomyces urogenitalis
atgaacaaataccggctcgaggaggagaccatggttcgcaagcccaccaaggaagacaagttctcattcggtctgtggaccgtcggctggctcgccgccgaccccttcggtgacaagacccgtgccgccctgcgtccctgggagtacaccgagaagctcgccgagctgggcgcctggggcatcaccttccacgacaacgacgtcttccccttcgacgccaccgacgccgagcgtgacgagatcgtccgcaagctcaaggacaccgtggacgccacgggcctgaccatcgagatggtcaccaccaacaccttcacccacccgatcttcaaggacggcggcctgaccaacaacgaccgctcgatccgccgcttcggcctgcgcaagatcctgcgcaacgtcgatctcgccgccgagctgggcgccaagacctttgtcatgtggggtggtcgtgagggcgctgagtacgactcctccaaggacctcaacgcggccttcgaccgctacaaggagggcctggacaccgtcgcccagtacatcaaggacaagggctacgacctcaagatcggcctggagcccaagccgaacgagccccgcggtgacatcttcctgcccaccgtcggccacgccctggccctcattgcccagctggacaacggcgacatcgtgggcctgaaccccgaggtcggccacgagcagatggcgaacctcaactacacccacggcatcgcccaggccctcaaccacggcaagctcttccacatcgacctcaacggccagaagggcctgaagtacgaccaggacctggtcttcggccacggcgacctgctgtccgccttcttcaccgtggacctcatcgtcaacggcttcccgaacggcggcccgcgctacgacggcccgatccacttcgactacaagccctcgcgcaccgatggcatggagggcgtgtgggagtccgctgccgccaacatggagatgtggctgcagctcaaggaaaaggcccaggccttccgcgccgaccccgaggtccaggaggctctcaagctctccggcatctacgagctcggcgagcccaccctggccgagggtgagtccctggaggacttcatcgctgaccgctctgcctacgaggactttgacgctgaggctgccgccgcgcgcgactaccacttcgtcaacctctaccagaaggccgtcatgcacctgatcggctga

SEQ ID NO: 14 - protein, 403 aa, Actinomyces urogenitalis
MNKYRLEEETMVRKPTKEDKFSFGLWTVGWLAADPFGDKTRAALRPWEYTEKLAELGAWGITFHDNDVFPFDATDAERDEIVRKLKDTVDATGLTIEMVTTNTFTHPIFKDGGLTNNDRSIRRFGLRKILRNVDLAAELGAKTFVMWGGREGAEYDSSKDLNAAFDRYKEGLDTVAQYIKDKGYDLKIGLEPKPNEPRGDIFLPTVGHALALIAQLDNGDIVGLNPEVGHEQMANLNYTHGIAQALNHGKLFHIDLNGQKGLKYDQDLVFGHGDLLSAFFTVDLIVNGFPNGGPRYDGPIHFDYKPSRTDGMEGVWESAAANMEMWLQLKEKAQAFRADPEVQEALKLSGIYELGEPTLAEGESLEDFIADRSAYEDFDAEAAAARDYHFVNLYQKAVMHLIG

SEQ ID NO: 15 - DNA, 1164 bp, Streptomyces ambofaciens
atgaactaccagcccactcccgaggacaggttcacgttcggtttgtggacggtcggctggcagggccgggaccccttcggcgacgccacccggcgggcgctggacccggcggagtcggtacggcgcctggccgagctgggcgcgtacggggtcacgttccacgacgacgacctgatcccgttcgggtcgagcgacaccgagcgcgaggagcacgtcaagcggttccggcaggcgttggacgcgacgggcatgaaggtgccgatggcgacgacgaacctgttcacgcacccggtgttcaaggacggtgccttcaccgcgaacgaccgcgacgtgcgccggtacgcgctgcgcaagaccatccgcaacatcgatctcgcggtggagctgggcgcgagcgtgtacgtcgcctggggcggccgggagggtgcggaatccggcgcggccaaggacgtgcgggacgcgctggaccggatgaaggaggccttcgacctgctgggcgagtacgtcaccgagcagggctacgacctgaagttcgcgatcgagcccaagccgaacgagccccgcggcgacatcctgctgccgacggtgggacacgcgctggcgttcatcgagcggctggagcggccggagctctacggcgtgaacccggaggtcggacacgagcagatggcggggctgaacttcccgcacggcatcgcacaggcgctgtgggcgggcaagctgttccacatcgacctcaacggccagtccggtatcaagtacgaccaggacctccggttcggcgcgggtgacctgagggccgctttctggctggtcgacctgctggagcgggccgggtacgcggggccgcggcacttcgacttcaagccgccgcggaccgaggacctcgacggcgtgtgggcgtcggcggccggctgcatgcgcaactacctcatcctcaaggaccgggcggccgccttccgtgccgacccgcaggtgcaggaggcgctcgccgcggcgcgactggacgagctggcccgaccgaccgccgaggacggtctcgcggccctgctggccgacccgaccgcgtacgacaccttcgacgtggacgaggccgccgcccgcggcatggccttcgagcacctcgaccagctcgccatggaccaccttctcggcgctcgctga

SEQ ID NO: 16 - protein, 387 aa, Streptomyces ambofaciens
MNYQPTPEDRFTFGLWTVGWQGRDPFGDATRRALDPAESVRRLAELGAYGVTFHDDDLIPFGSSDTEREEHVKRFRQALDATGMKVPMATTNLFTHPVFKDGAFTANDRDVRRYALRKTIRNIDLAVELGASVYVAWGGREGAESGAAKDVRDALDRMKEAFDLLGEYVTEQGYDLKFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLERAGYAGPRHFDFKPPRTEDLDGVWASAAGCMRNYLILKDRAAAFRADPQVQEALAAARLDELARPTAEDGLAALLADPTAYDTFDVDEAAARGMAFEHLDQLAMDHLLGAR

SEQ ID NO: 17 - DNA, 1188 bp, Salinispora arenicola
atggcgccccatcccacccctgccgacaagttctccttcggactctggacggtgggctggcaggcccgggatccgttcggagacgccacccgcccggagttggacgcggtcgaggcggtgcaccggctcgccgagttgggcgcatatggcatcaccttccacgacgacgacctgattccctttggggcggacgccgccacccgcgacgcccgcctgagccggttccgccgggccctcgacgagaccggcctggtggtgccgatggtcaccaccaacctcttcacccatcccgtgttcaaggacggcggcctcaccagtaacgaccgcgatgtccggcggtacgcgttacgcaaggtgctgcgcaccgtcgaccttgccgtggagctgggtgcgcgtaccttcgtgatgtggggtggacgcgagggcgccgagtacgacgtcgccaaggacgtccgcgccgccctcgaccgctaccgcgaggcggtcgacctgctctgccagtacaccgtggaccaggggtacgacctgcgtttcgcgatcgagcccaagcccaacgagccccgcggcgacatcctgctgccgactgtcgggcacgcactcgccttcatcgccaccctggcccgcccggagctggtcggcctgaatccggaggtcggccacgagcagatggctgggctcaacgtcacccacggcatcgcccaggcgctctggcagggcaagctgttccacctcgacctcaacggccagcggggcatcaagtacgaccaagacctggtcttcggccacggtgatctgctcaacgcgttcgccctggttgatctgctcgagaacggtggccccggcggtgcgccggcgtacgacggcccccggcacttcgactacaagccgtcccgcaccgaggacagcgccggggtgtgggtttcggccggggcgaacatgcgtacctatctgttactcaaggaacgggccgcggcgttccgggcggacccggaggtcatcgaggcgctggccgcgagccgggtgggcgagctggccacgccgacgctcgcccctggcgagagccacgccgggctcctcgccgaccgctccgccttcgaggagtacgacgtgggcgccgccgcgacacgtggcttcgacttcgtccggctcaaccaactcgccgtcgagcatctgctcggtgcccgctga

SEQ ID NO: 18 - protein, 395 aa, Salinispora arenicola
MAPHPTPADKFSFGLWTVGWQARDPFGDATRPELDAVEAVHRLAELGAYGITFHDDDLIPFGADAATRDARLSRFRRALDETGLVVPMVTTNLFTHPVFKDGGLTSNDRDVRRYALRKVLRTVDLAVELGARTFVMWGGREGAEYDVAKDVRAALDRYREAVDLLCQYTVDQGYDLRFAIEPKPNEPRGDILLPTVGHALAFIATLARPELVGLNPEVGHEQMAGLNVTHGIAQALWQGKLFHLDLNGQRGIKYDQDLVFGHGDLLNAFALVDLLENGGPGGAPAYDGPRHFDYKPSRTEDSAGVWVSAGANMRTYLLLKERAAAFRADPEVIEALAASRVGELATPTLAPGESHAGLLADRSAFEEYDVGAAATRGFDFVRLNQLAVEHLLGAR

SEQ ID NO: 19 - DNA, 1167 bp, Streptomyces sp.
atgaactaccagcccacccccgaggacaggttcaccttcggcctgtggaccgtcggctggcaggggcgggaccccttcggcgacgccacgcgtcccgccctcgacccggtcgaggcggtgcagcggctggccgaactgggcgcctacggagtgaccttccacgacgacgacctgatccccttcggggcgtccgacaccgagcgcgaggcgcacgtcaagcggttccgtcaggcgctcgacgcgaccggcatgaccgttccgatggccaccaccaacctcttcacccaccccgtcttcaaggacggcgcgttcaccgccaacgaccgcgacgtgcgccgttacgccctgcgcaagaccatccggaacatcgatctcgcggtcgagctgggcgccaaggtctacgtcgcctggggcggccgcgagggcgcggagtccggtgccgccaaggacgtgcgtgcggccctggaccgcatgaaggaggccttcgacctgctcggcgagtacgtcacctcgcagggctacgacatccggttcgccatcgagcccaagccgaacgagccgcgcggcgacatcctgctgcccaccatcggccacgcgctcgccttcatcgagcgcctggagcgccccgagctgtacggtgtcaaccccgaggtgggccacgagcagatggccggcctgaacttcccgcacggcatcgcgcaggctctgtgggcgggcaagctcttccacatcgacctcaacggccagtccggcatcaagtacgaccaggacctgcgcttcggcgccggtgacctgcgcgccgccttctggctggtcgacctgctggagagcgccggctgggagggtccgcgccacttcgacttcaagcccccgcggaccgaggacatcgacggcgtgtgggcctccgcggccgggtgcatgcgcaactacctgatcctgaaggagcgcgccgccgccttccgtgccgacccggaggtccaggaggccctgcgtgccgcccggctcgaccagctcgccgagcccaccgcggccgacggcctgcaggccctgctggccgaccgcaccgcgtacgaggacttcgacgtggacgcggccgccgcgcgcggcatggccttcgagcgcctcgaccagctcgccatggaccacctgctgggcgcccgcggctga

SEQ ID NO: 20 - protein, 388 aa, Streptomyces sp.
MNYQPTPEDRFTFGLWTVGWQGRDPFGDATRPALDPVEAVQRLAELGAYGVTFHDDDLIPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 21 - DNA, 1164 bp, Meiothermus silvanus
atggcatacgaacccaaacccgagcacaagttcaccttcggcctgtggaccgtgggcaacgtggggcgcgaccccttcggcctgcccacccgcccccccctcgagcccgactacatcgtctacaagctggccgagatcggcgcctacggggtcaacctgcacgacaacgacctcatccccgtcgaggccaccgaggccgagcgcgagcgcatcctcaagcgcttcaagaaggccctgcaggacaccggcttggtggtccccatggcgacgaccaacctcttcggcgaccccgccttcaaggacggcgccttcacctcgcccgacgcgcgggtgcgggcttatgccctccagaagaccatgcgggccatggacctcggcgccgagctcggcgcgaagacctacgtcttctggggcgggcgcgagggggccgaggtggacgccgggggcaacgtgctcgacgccctcgcccactaccgcgaggcgctgaacttcctggccgagtactccgaggaccagggctacggctaccgcttcgccctcgagcccaagcccaacgagccgcggggcgacatctacctgccggtggtgggggcagcgctgggcttcatcgccacgctggacaagccccacctcttcggcctcaaccccgaggtggcccacgagaccatggcgggcctcaacttcgtgcacgcggtggcccaggccatcgacgcgggcaagctcttccacatcgacctcaacgaccagaagatgggccgcttcgaccaggatttgcgcttcggcgccgagaacctcaagacggccttcttcctggtcaagctgctggaggactccggctacgacggcccccgccacttcgacgcccacgccctgcgcaccgaggacgaggcgggggtgtgggagttcgccaagggctgcatgaggacctacctcatcctcaaggagaaggccgagcgcttcggccgcgaccgcgagatccaggacctcatcggggcctacaaggtccaggacgaggcgctcgcccggctcaccgcgaagtacagccgcgagaacgcccgggcgctgaaggggctcgagttcgaccgcgaggcgctggggcggcgggggccgggcctggagcggctggaccaactcacggtggagctgctgctcggggtcaggtga

SEQ ID NO: 22 - protein, 387 aa, Meiothermus silvanus
MAYEPKPEHKFTFGLWTVGNVGRDPFGLPTRPPLEPDYIVYKLAEIGAYGVNLHDNDLIPVEATEAERERILKRFKKALQDTGLVVPMATTNLFGDPAFKDGAFTSPDARVRAYALQKTMRAMDLGAELGAKTYVFWGGREGAEVDAGGNVLDALAHYREALNFLAEYSEDQGYGYRFALEPKPNEPRGDIYLPVVGAALGFIATLDKPHLFGLNPEVAHETMAGLNFVHAVAQAIDAGKLFHIDLNDQKMGRFDQDLRFGAENLKTAFFLVKLLEDSGYDGPRHFDAHALRTEDEAGVWEFAKGCMRTYLILKEKAERFGRDREIQDLIGAYKVQDEALARLTAKYSRENARALKGLEFDREALGRRGPGLERLDQLTVELLLGVR

SEQ ID NO: 23 - DNA, 1185 bp, Actinoplanes sp.
gtgtcgctccaggccacacccgatgacaagttctccttcggtctctggaccgtcggctggcaggcgcgtgacgcgttcggtgacgccacccgtccggtcctcgacccgatcgaggccgtgcacaagctggccgagatcggcgcgtacggcgtcacgttccacgacgacgacctggtgccgttcggcgccgacgccgcgacccgcgacggcatcgtcgccgggttctccaaggcgctcgacgagaccggcctgatcgtcccgatggtcaccaccaacctgttcacccacccggtgttcaaggacggcggcttcaccagcaacgaccgcagcgtccggcggtatgcgatccgcaaggtgctgcgccagatggacctcggcgccgagctgggcgccaagaccctggtgctctggggcggccgcgagggcgccgagtacgactcggccaaggacgtcggcgccgccctcgaccgctaccgcgaggccctcaacctgctcgcgcagtactccgaggaccagggctacggcctgccgttcgccatcgagccgaagccgaacgagccccgcggcgacatcctgctcccgaccgccggccacgccatcgcgttcgtgcaggagctggagcgccccgagctgttcggcatcaaccgggagaccggccacgagcagatgtcgaacctgaacttcacccagggcatcgcccaggcgctgtggcacaagaagctgttccacatcgacctgaacggccagcacggcccgaagttcgaccaggacctggtcttcggtcacggtgacctgctcaacgcgttctccctggtcgacctcttggagaacgggcccgacggcggcccggcctacgacggcccgcggcacttcgactacaagccctcgcgcaccgaggacttcgacggcgtctgggagtcggccaaggacaacatccggatgtacctgctgctcaaggagcgggccaaggcgttccgggccgacccggaggtgcaggcggcgctggccgagtccaaggtcgacgagctgcggaccccgacgctgaacccgggcgagacctacgccgacctgctggccgaccgtagcgcgttcgaggactacgacgccgacgcggtcggggccaagggctacggcttcgtcaagctcaaccagctggcgatcgaccacctgctcggagcgcgctga

SEQ ID NO: 24 - protein, 394 aa, Actinoplanes sp.
MSLQATPDDKFSFGLWTVGWQARDAFGDATRPVLDPIEAVHKLAEIGAYGVTFHDDDLVPFGADAATRDGIVAGFSKALDETGLIVPMVTTNLFTHPVFKDGGFTSNDRSVRRYAIRKVLRQMDLGAELGAKTLVLWGGREGAEYDSAKDVGAALDRYREALNLLAQYSEDQGYGLPFAIEPKPNEPRGDILLPTAGHAIAFVQELERPELFGINRETGHEQMSNLNFTQGIAQALWHKKLFHIDLNGQHGPKFDQDLVFGHGDLLNAFSLVDLLENGPDGGPAYDGPRHFDYKPSRTEDFDGVWESAKDNIRMYLLLKERAKAFRADPEVQAALAESKVDELRTPTLNPGETYADLLADRSAFEDYDADAVGAKGYGFVKLNQLAIDHLLGAR

SEQ ID NO: 25 - DNA, 1167 bp, Mobiluncus curtisii
atgcgtaagccatgcaaagaagataaattttccttcggtatttggacagttggttggcagggtgtggacccgtttggggtagccacacgtgaagcattggatccttgggaatatgccgaaaagctcgccgagctaggtgcctggggtgtgacttttcacgataacgatgtgttcgattttgcagcaagtgaacaacagcgtcaagataccataaagagatttaaagaagcctgcgacggggcaggattagttattgaaatggttacgaccaacacatttactcatcctatttttaaggacggagggttgacgaacaatgaccgggaaattcgtcgcttcggcctcaagaaaattctgaaaaacgttgacttggctgcggaaatgggcgcctcgactttcgttatgtggggaggtcgcgaaggtgccgagtacgattcctccaaggatcttaacgccgcttttgaacggtacaaggaaggcttagatgctgttgcgggctacattaaagaaaaaggctacaacttgcgcatcggactggaacccaagccaaatgaacctcgcggtgacatcttcctgccctcagttggtcatgctctggcattaattgctgagctggaaaatggggacgtcgtgggtctgaacccagaaacaggtcatgaacaaatggctaatctgaactataaccacgctttggcacaagcgctgaatgctggaaagcttttccacattgatttgaacgggcaatctgggctgaaatatgaccaggataaatgcttcggtcacggagacttggcatctgctttcttcacagtggatttgctggtcaatgggttccccggaggcggaaatcgttatgaaggtccaattcattttgattataagccctctcggactgagggatttgaaggtgtttgggcttccgcggcggcgaacatggaaatgtatctaatgcttaaggaaaaagctctcgcattccgcgcggatccacttactaaggaacttatggaagcagcttccgtgttggagctgtgcaaacctaccatgaacgagggtgaaacttacgcggaatttatgaacagccctaccgttaacccggaacaggcatcgcaacgtgaatatcactttgtagagctgtaccaacaggctatgcgtcaccttgtgggatag

SEQ ID NO: 26 - protein, 388 aa, Mobiluncus curtisii
MRKPCKEDKFSFGIWTVGWQGVDPFGVATREALDPWEYAEKLAELGAWGVTFHDNDVFDFAASEQQRQDTIKRFKEACDGAGLVIEMVTTNTFTHPIFKDGGLTNNDREIRRFGLKKILKNVDLAAEMGASTFVMWGGREGAEYDSSKDLNAAFERYKEGLDAVAGYIKEKGYNLRIGLEPKPNEPRGDIFLPSVGHALALIAELENGDVVGLNPETGHEQMANLNYNHALAQALNAGKLFHIDLNGQSGLKYDQDKCFGHGDLASAFFTVDLLVNGFPGGGNRYEGPIHFDYKPSRTEGFEGVWASAAANMEMYLMLKEKALAFRADPLTKELMEAASVLELCKPTMNEGETYAEFMNSPTVNPEQASQREYHFVELYQQAMRHLVG

SEQ ID NO: 27 - DNA, 1161 bp, Herpetosiphon aurantiacus
atgtacgacgcacagcctgcccacaaatttacgtttggcctttggacggtcggcaatgttggccgtgatccctttggcgagccagttcgtaagccgctgagtcctcctgagattgtccatttactggcagaagttggcgcttggggcgtaaacttccacgataacgatttaattccaattgatgcaactcccagcgaacgcgactcaattatcaaggcctttcgtggcgctttagctgaaaccggtctcgttgtgccaatggcaactaccaacttattcagtcatccagcttttaaagatggcgcgtttaccagcaatgatccagcagtacgcgcctatgcgctgcaaaaaaccatggccgcgatggatttgggagccgaatttggggccacgacctatgtattttggggtggtcgcgaaggcagcgaaagcgatgccgccaaaaatccgcttgaaggcttgaagtggtttcgcgaggcgctcaactttttgtgtgaatatagcttggcccaaggctataactatcgctttgccttggaagcgaagcccaacgaaccacgcggcgacatctttttgcccaccaccggagccatgttgggctttatcgaaaccctcgatcattcagcaatggttggggttaaccctgaagtagcccacgaaaccatggcgggcttaaattttgcccatgctgtggcccaagcgcttgatgctggcaaacttttccacatcgacctcaacgatcaagccagtggtcgctatgatcaagatttccgctttgcagcgcataactacaagcaaaatttcttcttggtcaagttgctcgaagatgttggctatgatggcccacgccacttcgatgcccatgcctaccgctcagaagatttgcaaggggtcaaagattttgcccgtggctgtattcgcagctatctgattttggccgaaaaagcccgccgcttcaacgctgatgctgaaattcaaggtttgttggccgaattgaaaacagttgagccagcagtggcggcgttggctggtagctattcgccagaacgagttgccgcgctcaaggcgcatgaatttgatcggacggggctgggtgcacgcggtttgggctacgaaaagcttgatcaattgacatttgaattattgatgggtgttcgttaa

SEQ ID NO: 28 - protein, 386 aa, Herpetosiphon aurantiacus
MYDAQPAHKFTFGLWTVGNVGRDPFGEPVRKPLSPPEIVHLLAEVGAWGVNFHDNDLIPIDATPSERDSIIKAFRGALAETGLVVPMATTNLFSHPAFKDGAFTSNDPAVRAYALQKTMAAMDLGAEFGATTYVFWGGREGSESDAAKNPLEGLKWFREALNFLCEYSLAQGYNYRFALEAKPNEPRGDIFLPTTGAMLGFIETLDHSAMVGVNPEVAHETMAGLNFAHAVAQALDAGKLFHIDLNDQASGRYDQDFRFAAHNYKQNFFLVKLLEDVGYDGPRHFDAHAYRSEDLQGVKDFARGCIRSYLILAEKARRFNADAEIQGLLAELKTVEPAVAALAGSYSPERVAALKAHEFDRTGLGARGLGYEKLDQLTFELLMGVR

SEQ ID NO: 29 - DNA, 1224 bp, Acidothermus cellulolyticus
atgtcactcaccactgcatcgtcgaaaactatcgaagttgccacgccgtcgaaggaagaccgtttcagctttggtctgtggaccgtcggctggcaggcgcgtgatcccttcggtgaagcgacacgtccgccgctggatccggtggaggctgttcacaagctcgccgaattaggcgcctacggggtcaccttccatgacgacgacctcgttccgttcggcagcagcgatgcggagcgcgctcggcttatcgaccgtttcaagaaggcgcttgccgacaccggcctggtcgtcccgatgatgacgacgaatctcttcacccatccgatcttcaaggatggtgcgttcaccgccaatgaccggtccattcggcggtatgcgatccgtaaggtgatgcgcaatctggatctggcggccgaactcggcgcccgtacgtacgttttctggggtggccgcgagggaagcgaaatcgacgccgcaaaggacattcgtgctgcgcttgaccggtaccgcgaggcgattgacaccctcgcgcaatacgtcaaagaccaaggctacggcatccggttcgccctcgaaccgaaacccaatgagccgcggggtgatattttcctcccgacgatcgggcatgcgctcgcgttcatcaactccctggagcattcggacatcgtcgggctgaatcctgaagtcggtcacgagcagatgtccaatttgaatttcgtgcacgggatcgcacaggccctctggcacgggaaactcttccacatcgacctcaacggccagcacgggccgaagtacgaccaggacttggtcttcggtcacggtgacctgctcagcgcgttcttcctcgtcgacctgctggagaacggctttcccggcggcggcccggtgtacgacggtccgcggcacttcgactacaagccgatgcgcacggaggacatcgacggcgtctgggcgtccgccgcggcgaacatgcgcacgtacctcctcctcaagcagcgggcaaaggcgtttcgagcggatccggaggtgcaggccgcactcaccgcaagtcgtgttcccgagttggccgtccccaccctcggcgagggcgagtcgtacgccgacctgctggccgaccggtccgcgtgggaggaattcgacgtcgatcgagccgccaaccaaggctacgggtacgcccgtctcgatcagctcgccatcgagcacctcctcggcgcacgcggctga

SEQ ID NO: 30 - protein, 407 aa, Acidothermus cellulolyticus
MSLTTASSKTIEVATPSKEDRFSFGLWTVGWQARDPFGEATRPPLDPVEAVHKLAELGAYGVTFHDDDLVPFGSSDAERARLIDRFKKALADTGLVVPMMTTNLFTHPIFKDGAFTANDRSIRRYAIRKVMRNLDLAAELGARTYVFWGGREGSEIDAAKDIRAALDRYREAIDTLAQYVKDQGYGIRFALEPKPNEPRGDIFLPTIGHALAFINSLEHSDIVGLNPEVGHEQMSNLNFVHGIAQALWHGKLFHIDLNGQHGPKYDQDLVFGHGDLLSAFFLVDLLENGFPGGGPVYDGPRHFDYKPMRTEDIDGVWASAAANMRTYLLLKQRAKAFRADPEVQAALTASRVPELAVPTLGEGESYADLLADRSAWEEFDVDRAANQGYGYARLDQLAIEHLLGARG

SEQ ID NO: 31 - DNA, 1164 bp, Streptomyces coelicolor
atgaactaccagcccactcccgaggacaggttcacgttcggtttgtggacggtcggctggcagggccgtgacccgttcggtgacgccaccaggcaggccctggaccccgccgagtcggtacggcgtctgtccgagctgggtgcgtacggcgtcacgttccacgacgacgacctgatccccttcgggtcgagcgacacggagcgggagtcgcacatcaagcggttccggcaggcgctggacgcgaccggcatgaaggtgccgatggcgacgacgaacctgttcacgcacccggtgttcaaagacggcgccttcacggcgaacgaccgggacgtgcggcggtacgcgctgcgcaagacgatccgcaacatcgacctcgcggtcgagctgggcgcgagcgtctacgtggcctggggcggccgggagggtgcggagtccggcgcggccaaggacgtgcgggacgcgctcgaccggatgaaggaggccttcgacctgctgggcgagtacgtcaccgagcagggctacgacctgaagttcgcgatcgagccgaagcccaacgagccgcgcggtgacatcctgctcccgacggtcggccacgccctcgccttcatcgagcgcctcgagcggccggagctgtacggcgtgaacccggaggtcggccacgagcagatggccggcctgaacttcccccacggcatcgcccaggcgctgtgggcgggcaagctcttccacatcgacctcaacggccagtcgggcatcaagtacgaccaggacctgaggttcggcgcgggcgacctgcgggccgcgttctggctcgtcgacctgctggagcgggccgggtacgcgggtccgcggcacttcgacttcaagccgccgcggaccgaggacttcgacggcgtgtgggcgtcggccgccggctgcatgcgcaactacctgatcctcaaggaccgggcggcggcattccgcgccgacccgcaggtgcaggaggcgctggccgcggcccggctggacgaactggcccgcccgaccgccgaggacggtctcgccgccctgctggccgaccggagcgcctacgacaccttcgacgtggacgcggccgccgcgcgaggcatggcgttcgagcacctcgaccagctcgccatggaccacctcctcggcgcccgctga

SEQ ID NO: 32 - protein, 387 aa, Streptomyces coelicolor
MNYQPTPEDRFTFGLWTVGWQGRDPFGDATRQALDPAESVRRLSELGAYGVTFHDDDLIPFGSSDTERESHIKRFRQALDATGMKVPMATTNLFTHPVFKDGAFTANDRDVRRYALRKTIRNIDLAVELGASVYVAWGGREGAESGAAKDVRDALDRMKEAFDLLGEYVTEQGYDLKFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLERAGYAGPRHFDFKPPRTEDFDGVWASAAGCMRNYLILKDRAAAFRADPQVQEALAAARLDELARPTAEDGLAALLADRSAYDTFDVDAAAARGMAFEHLDQLAMDHLLGAR

SEQ ID NO: 33 - DNA, 1167 bp, Streptomyces avermitilis
atgaactaccagcccacccccgaggacaggttcaccttcggcctgtggaccgtcggctggcagggaagggacccgttcggcgacgccacccggcgcgccctggacccggtcgagacggtgcagcgcctcgccgggctcggtgcccacggagtgaccttccacgacgacgacctgatccccttcgggtcctcggacaccgagcgcgagtcgcacatcaagcgcttccggcaggccctcgacgccaccggcatggccgtgccgatggccaccaccaacctcttcacgcaccccgtcttcaaggacggggcgttcaccgccaacgaccgggacgtccgccgttacgccctgcgcaagacgatccgcaacatcgacctcgcggccgagctgggggcgaagacgtacgtcgcctggggcggccgggagggtgccgagtccggcgccgccaaggacgtacgcgtcgcactcgaccggatgaaggaggccttcgacctcctcggcgagtacgtcaccgcccagggctacgacctgcgtttcgccatcgagcccaagccgaacgagccgcgcggcgacatcctgctgccgaccgtcggccacgcgctggcgttcatcgagcgcctggaacgcccggagctgtacggcgtcaaccccgaggtgggtcacgagcagatggccgggctgaacttcccgcacggcatcgcccaggccctgtgggcgggcaagctcttccacatcgacctcaacggccagtccggcatcaagtacgaccaggacctgcgcttcggggcgggcgatctgcgcgccgccttctggctggtcgaccttctggagagcgccggctacgagggcccgaagcacttcgacttcaagccgccgcggacggaggacctcgacggcgtgtgggcctcggccgcgggctgcatgcgcaactacctcatcctcaaggagcgtacggccgccttccgcgccgaccccgaggtccaggaggcgctgcgcgccgcgcggctggacgagctggcgcagcccaccgccggggacggtctgacggcgctgctcgccgaccgtacggcgttcgaggacttcgacgtggaggcggccgccgcgcgggggatggccttcgagcagttggaccagctggcgatggaccacctgctgggggcgcgtggctga

SEQ ID NO: 34 - protein, 388 aa, Streptomyces avermitilis
MNYQPTPEDRFTFGLWTVGWQGRDPFGDATRRALDPVETVQRLAGLGAHGVTFHDDDLIPFGSSDTERESHIKRFRQALDATGMAVPMATTNLFTHPVFKDGAFTANDRDVRRYALRKTIRNIDLAAELGAKTYVAWGGREGAESGAAKDVRVALDRMKEAFDLLGEYVTAQGYDLRFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLESAGYEGPKHFDFKPPRTEDLDGVWASAAGCMRNYLILKERTAAFRADPEVQEALRAARLDELAQPTAGDGLTALLADRTAFEDFDVEAAAARGMAFEQLDQLAMDHLLGARG

SEQ ID NO: 35 - DNA, 1158 bp, Nocardiopsis dassonvillei
atgagcagctaccagcccgtgcccgcggacaggttcaccttcggtctgtggaccgtggggtggcgcggggtgaacaccttcggcgaccccgtccgcccggcgctcgacccggtggacgccgtccgccgcctcgccgacctcggcgcgcacgggatcaccttccacgacgacgacctcatcccgcccggcagctccgacaccgagcgcgaggacatcctcaagcggttccgcgcggccctggacgagaccgggctcaaggtgccgatggcgaccaccaacctgttctcggacccggtgttccgcgacggcgggttcacctccaacagccgcgacgtgcgccggtacgccatccgcaaggtcatccgcaacatcgagctggccgtgtcgctgggcgccgagacctacgtgtgctggggaggcatggacggcgccgagaccgaggcgggcaagaacgaccacgccgccctggaccggctgcgcgaggccttcgacatcctgtgcggctacgtgcgcgagcagggccacgacctgcgcttcgccctggagcccaagcccaacgagccgcgcggcgacatcctgctgcccacggtggggcacgccctggccttcatcaacgagctggagcaccccgagatggtgggggtcaacccggaggtcggccacgagcagatggccgggctgaacttcgcgcacggcgtcgcgcaggccctgtgggcgggcaagctcttccacatcgacctcaacggccagcgcgggatcaagtacgaccaggacctgcgcttcggctcgggcgacgtcaaggaggcgttcttcctggtggacctgctggagagcgcgggctacgacggcccgctgcacttcgacttcaagacgccgcgcaccgaggacatgagcggcgtgtgggagtcggccgcggcctgcatgcgcaactacctcatcctcaaggagaaggccagggcgttccgcgccgaccccgaggtggtggagtcgctcgcggcctcgcgcgtgcccgagctgtcccagtccacgctgggcgagggcgagtccctgtccgacctgctggccgaggagatcgacctggccgaggtcggtgagcggggctaccacttcgagcgcctggaccagctcgccatggagcacctgttcggcctgcgctga

SEQ ID NO: 36 - protein, 385 aa, Nocardiopsis dassonvillei
MSSYQPVPADRFTFGLWTVGWRGVNTFGDPVRPALDPVDAVRRLADLGAHGITFHDDDLIPPGSSDTEREDILKRFRAALDETGLKVPMATTNLFSDPVFRDGGFTSNSRDVRRYAIRKVIRNIELAVSLGAETYVCWGGMDGAETEAGKNDHAALDRLREAFDILCGYVREQGHDLRFALEPKPNEPRGDILLPTVGHALAFINELEHPEMVGVNPEVGHEQMAGLNFAHGVAQALWAGKLFHIDLNGQRGIKYDQDLRFGSGDVKEAFFLVDLLESAGYDGPLHFDFKTPRTEDMSGVWESAAACMRNYLILKEKARAFRADPEVVESLAASRVPELSQSTLGEGESLSDLLAEEIDLAEVGERGYHFERLDQLAMEHLFGLR

SEQ ID NO: 37 - DNA, 1194 bp, Nakamurella multipartita
atggtccgtgcggcaacccccgacgatcgtttctcgttcggcctgtggacggtgtcctggcaggcccgcgaccccttcggtgacgccacccggccggcgcttgacccggtggaggcgatcggcaagctggccgaggccggcgcgtggggcgtcaccttccatgacgacgacgtggtgccgttcggctccgacgacgcgacccgcgaccggctgatcaccgccttccgggatgcctgcaccgagcacgacgtgaccatcgagatggtcaccaccaacctgttcacccaccccgtcttcaaggacggcggcttcacctccaacgaccgttcggtccgccggttcgcgctgcgcaaggtgctgcgcaacatcgacctgaccgccgagctgggggccaagacgttcgtcatgtggggcggccgggaaggcagcgagtacgacgggtccaaggacgtcaacgccgcgctcgaccggtacgccgagggcgtggacacggtggccgcctacatcaagagccgcggctacgacatcaagatcgccctggagcccaagccgaacgagccccggggtgacatcttcctgccgaccatcgggcacgcgcttggctttatcgccaagctcgagcacggcgacatcgtcgggctgaaccccgaggtcgggcacgagcagatggccgggctcaacttcacccagggcatcgggcaggcgctgtgggccggcaagctgttccacatcgatctcaacggccagcggtccatcaagtacgaccaggacctggtgttcggtcacggcgacctgctgtccgcgttcttcaccgtggacctgctcgagaacggcttccccaacggcggtccccgctacgacggtccgcggcacttcgactacaagccctcgcgcacggacggcttcgacggcgtgtgggcctccgcccgggccaacatcgccacctacctgctgctcaaggagcgggcgctggccttccgggccgatccggaggtgcaggccgcgctcgaggcgtcgggtctgtccgaactggccgtcccgaccctcgccgccggcgagagcatcgaggacctgctggccgacgaatccgcgttcgagagctacgacgccgacaaggcggccgagcactcctacgccttcgtgcacctgaaccagctcgcggtcgagcacgccctgggtgcccggctgagctga

SEQ ID NO: 38 - protein, 397 aa, Nakamurella multipartita
MVRAATPDDRFSFGLWTVSWQARDPFGDATRPALDPVEAIGKLAEAGAWGVTFHDDDVVPFGSDDATRDRLITAFRDACTEHDVTIEMVTTNLFTHPVFKDGGFTSNDRSVRRFALRKVLRNIDLTAELGAKTFVMWGGREGSEYDGSKDVNAALDRYAEGVDTVAAYIKSRGYDIKIALEPKPNEPRGDIFLPTIGHALGFIAKLEHGDIVGLNPEVGHEQMAGLNFTQGIGQALWAGKLFHIDLNGQRSIKYDQDLVFGHGDLLSAFFTVDLLENGFPNGGPRYDGPRHFDYKPSRTDGFDGVWASARANIATYLLLKERALAFRADPEVQAALEASGLSELAVPTLAAGESIEDLLADESAFESYDADKAAEHSYAFVHLNQLAVEHALGARLS

SEQ ID NO: 39 - DNA, 1155 bp, Xylanimonas cellulosilytica
gtgagcgacatcaagtacgcgttcggcctctggaccaccggctggcagggcgtcgacccgttcggcgacgcgacccgcccggctctcgacccggccgagaacatccgcaagctcgccgagctcggcgcgcacgcgttcaccttccacgacaacgacgtgtggcccatcgacgccaccgacgccgagcgcgccgccgcgatcgagtcggtcaagaaggcctccgccgagaccggcctggtctgcgagatggtcaccaccaacacgttctcgcacccggtgttcaaggccggcgcgttcacctcgaacgaccgcaacatccgccgctacggcctgcgcaaggtcctcaagcaggtcgacctcggtgccgagctgggcgccagcacgttcgtcatgtggggcggccgcgagggcgtcgagtacgcgaactcgaaggacctgggcaccgcccacgcccgttacgccgagggcatcgacaccgtcgccgcctacatcaagtcgaagggctacgacatgcgcgtcgccctcgagccgaagccgaacgagccccgcggcgacatcttcctgccgacgatcggtcacgccatcgcgctgatcaactcgctcgacaacggcgacatcgtcggcgtgaacccggagacgggccacgagcagatggccggcctgaactacacccacggcctcgccctcgccctgtacgtcggcaagctgttccacatcgacctcaacggtcagaacggcccgaagtacgaccaggacctcgtcttcggtcacggcaacctgctcgacgccttcttcaccgtcgacctgctcgagaacggctcgccgaacggcgagatcgctccttacgtcggctaccgccacttcgactacaagccctcgcgtaccgagtacacggacggcatctgggagtcggctgccgccaacatgaagacctactcgctgctcgccgaggcctcgaaggcgtaccgcgccgacgccgaggtccaggccgcgttcgagaaggccggcgtgctcgacaagtcggcgaccctcgccgagggcgagtcgttcgagtcgttcctcgcggagcccgacgaggacatcaccgagctcggcaagcgtcacgagggcctggtgcacctgcaccagctcgcgctgaaccacatcctcggctga

SEQ ID NO: 40 - protein, 384 aa, Xylanimonas cellulosilytica
MSDIKYAFGLWTTGWQGVDPFGDATRPALDPAENIRKLAELGAHAFTFHDNDVWPIDATDAERAAAIESVKKASAETGLVCEMVTTNTFSHPVFKAGAFTSNDRNIRRYGLRKVLKQVDLGAELGASTFVMWGGREGVEYANSKDLGTAHARYAEGIDTVAAYIKSKGYDMRVALEPKPNEPRGDIFLPTIGHAIALINSLDNGDIVGVNPETGHEQMAGLNYTHGLALALYVGKLFHIDLNGQNGPKYDQDLVFGHGNLLDAFFTVDLLENGSPNGEIAPYVGYRHFDYKPSRTEYTDGIWESAAANMKTYSLLAEASKAYRADAEVQAAFEKAGVLDKSATLAEGESFESFLAEPDEDITELGKRHEGLVHLHQLALNHILG

SEQ ID NO: 41 - DNA, 1194 bp, Clavibacter michiganensis
atggcgctcacccccacccgcgaggacaagttctcgttcggactctggaccatcggctacacgggggccgatcccttcggcggcccgacccgctccgacctcgacgtggtcgagggcgtcgagcgcatctcggagctgggcgcctacggcctcaccttccacgacgacgacctcttcgccttcggatccaccgacgccgagcgccagacgcagatcgaccgcctcaagggcgcgctcagcgacaccggcatcgtcgtgccgatggtcaccaccaacctcttcagcgcgcccgtcttcaaggacggcggcttcaccagcaacgaccgcgccgtccgccggttcgcgatccgcaaggtcctccgcaacatcgacctcgccgccgagctcggcgcgcagacgttcgtgatgtggggcggccgcgagggcgccgagtacgactccgccaaggacgtccggggcgcgctcgagcgctaccgcgaggccgtcaacctgctcggcgactacgtcaccgacaagggctacgacatccgcttcgcgatcgagccgaagcccaacgagccccgcggcgacatcctgctgcccaccctcggccacgcgctcgccttcatcgagaccctcgagcgccccgagctcgtcggcgtcaaccccgaggtcggccacgagcagatggcgggcctcaacttcaccgccggcatcatgcaggcgctgtaccagggcaagctcttccacatcgacctcaacggccagcgcggcatcaagtacgaccaggacctcgtcttcggccacggcgacctgcagaacgcgttctcgctcgttgacctgctggagaacggcggcgtgggcggcggccgctcgtacgacggcccgcgtcacttcgactacaagcccagccgcaccgaggacatcacgggcgtgtgggactcggcggccgcgaacatgcgcatgtacctgctcctcaaggagcgcgcgcaggcgttccgcgccgaccccgaggtccaggaggcgctcgccgccgccaaggtccaggagatctacacgccgacgctgaacgagggcgagagctacgacgacatcctcgccgaccgctcctcctacgaggacttcgacgccccgtcgtacttcgacgccaagggcttcggcttcgtccgcctcaaccagctggcgctcgagcacctcatgggcgcgcgttcgtag

SEQ ID NO: 42 - protein, 397 aa, Clavibacter michiganensis
MALTPTREDKFSFGLWTIGYTGADPFGGPTRSDLDVVEGVERISELGAYGLTFHDDDLFAFGSTDAERQTQIDRLKGALSDTGIVVPMVTTNLFSAPVFKDGGFTSNDRAVRRFAIRKVLRNIDLAAELGAQTFVMWGGREGAEYDSAKDVRGALERYREAVNLLGDYVTDKGYDIRFAIEPKPNEPRGDILLPTLGHALAFIETLERPELVGVNPEVGHEQMAGLNFTAGIMQALYQGKLFHIDLNGQRGIKYDQDLVFGHGDLQNAFSLVDLLENGGVGGGRSYDGPRHFDYKPSRTEDITGVWDSAAANMRMYLLLKERAQAFRADPEVQEALAAAKVQEIYTPTLNEGESYDDILADRSSYEDFDAPSYFDAKGFGFVRLNQLALEHLMGARS

SEQ ID NO: 43 - DNA, 1188 bp, Salinispora tropica
atggcgccccgtcccacccctgctgacaagttctccttcggcctctggacggtgggctggcaggcccgggacccgttcggcgacgccacccgaccgccgctggacgcggtcgaggcggtgcaccgccttgccgacctgggggcgtacggcatcacctttcacgatgatgatctgatccccttcgaggcggacgctgccgtccgcgatgcccacctcacccggttccgtcgggccctcgacgagaccggcctggtggtcccgatggtcaccaccaacctcttcacccatcccgtgttcaaggacggcggcttcaccagcaacgaccgggacgtccggcggtacgcgctccgcaaggcgctgcgtgccgtggacctcgccgcccagctgggcgcgcgcaccttcgtcctgtggggtggtcgggagggtgccgagtacgacgtcgccaaggatgtccgcgccgccctggaccgctaccgcgaggcggttgacctgctctgccagtacgtcgtggcgcagggatacgagctgcggttcgcgatcgagcccaagcccaacgagccgcgcggcgacattctgctgcccaccgtcgggcacgcgctcgccttcatcgccaccctggcccgcccggagctggtcggtctcaacccggaggtcggccatgagcagatggccgggctcaacgtcgcccacggcattgctcaggcgctctggcagggcaagctgtttcacctcgacctcaacggccagcgtggggtcaagtacgaccaggacctggtcttcggccatggtgacctgcttaacgccttcgcactggtcgacctactcgagaacggtggtccaggcggcgggccggcgtatgacggtccccggcacttcgactacaaaccgtctcgtaccgaggaccggaccggggtgtgggcctcggccgaggcaaacatgcgcacctacctgctcctcaaggagcgggccgcggtgttccgggccgatccggaggtcaccgcggcgctggccacgagccgggtgggtgagctggcaacgccaaccctcgcccccggcgagacccacgccggtctccgcgccgatcgcactgccttcgaggagtacgacgtgaccgctgccggcgctcgcggctaccacttcgttcggctcaaccaactcgccgtcgagcatctgctcggtgcgcgctga

SEQ ID NO: 44 - protein, 395 aa, Salinispora tropica
MAPRPTPADKFSFGLWTVGWQARDPFGDATRPPLDAVEAVHRLADLGAYGITFHDDDLIPFEADAAVRDAHLTRFRRALDETGLVVPMVTTNLFTHPVFKDGGFTSNDRDVRRYALRKALRAVDLAAQLGARTFVLWGGREGAEYDVAKDVRAALDRYREAVDLLCQYVVAQGYELRFAIEPKPNEPRGDILLPTVGHALAFIATLARPELVGLNPEVGHEQMAGLNVAHGIAQALWQGKLFHLDLNGQRGVKYDQDLVFGHGDLLNAFALVDLLENGGPGGGPAYDGPRHFDYKPSRTEDRTGVWASAEANMRTYLLLKERAAVFRADPEVTAALATSRVGELATPTLAPGETHAGLRADRTAFEEYDVTAAGARGYHFVRLNQLAVEHLLGAR

SEQ ID NO: 45 - DNA, 1167 bp, Streptomyces sp.
atgaactaccagcccacccccgaggacaagttcagcttcggtctgtggaccgtcggctggcagggccgggaccccttcggggacgccacccgccccgcgctcgacccggtcgaatccgtgcgccgcctggccgagctgggcgcctggggcgtcaccttccacgacgacgacctcatccccttcggctccaccgacgccgagcgcgagcgcatcgtcaagcgcttccgcgaggcgctcgacacgcacggcctcgtcgtcccgatggcgacgaccaacctcttcacgcaccccgtcttcaaggacggcggcttcacgtccaacgaccgcgacgtacgccgctacgcgctccgcaaggtcatccgcaacatcgacctcgccgccgagctcggggccgagacgtacgtcgcctggggcggtcgcgagggtgccgagtccggcggcgccaaggacatccgcctcgcgctcgaccgcatgaaggaggcgttcgacctcctcggcgagtacgtcaccgagcagggctacgacctccgcttcgccatcgagcccaagcccaacgagccgcgcggcgacatcctgctccccaccgtcggccacgccctcgccttcatcgagcgcctggagcgcccggagctgtacggcgtcaacccggaggtcggccacgagcagatggccgggctcaacttcgcccacggcatcgcgcaggcgctgtggtccggcaagctcttccacctcgacctcaacggccagaacggcatcaagtacgaccaggacctgcgcttcggcgccggtgacgtgcgcaacgccttctggctcgtggacctcctggagaccgccgggtacgagggcccgcgccacttcgacttcaagcccccgcggaccgaggacttcgacggcgtgtgggcctcggcggcgggctgtatgcgcaactacctcatcctcaaggagcgcgccgcggccttccgcgccgacccgagggtgcgggacgccctcaaggccgcgcgtctcgaccagctcgccctgcccaccgccgaggacggcctcgcctccctgctcggcgacaagagcgcgtacgaggacttcgacgtggaggccgccgccgagcgcggcatggccttcgaggcgctcgaccagctcgccacggaccacctgctgggcgtccagggctga

SEQ ID NO: 46 - protein, 388 aa, Streptomyces sp.
MNYQPTPEDKFSFGLWTVGWQGRDPFGDATRPALDPVESVRRLAELGAWGVTFHDDDLIPFGSTDAERERIVKRFREALDTHGLVVPMATTNLFTHPVFKDGGFTSNDRDVRRYALRKVIRNIDLAAELGAETYVAWGGREGAESGGAKDIRLALDRMKEAFDLLGEYVTEQGYDLRFAIEPKPNEPRGDILLPTVGHALAFIERLERPELYGVNPEVGHEQMAGLNFAHGIAQALWSGKLFHLDLNGQNGIKYDQDLRFGAGDVRNAFWLVDLLETAGYEGPRHFDFKPPRTEDFDGVWASAAGCMRNYLILKERAAAFRADPRVRDALKAARLDQLALPTAEDGLASLLGDKSAYEDFDVEAAAERGMAFEALDQLATDHLLGVQG

SEQ ID NO: 47 - DNA, 1170 bp, Streptomyces pristinaespiralis
atgacggaacgcttcacccccacccccgacgacaagttcagcttcggcctctggacggtcggctggcagggccgggacccgttcggggacgcgacccggccgcacctggaccctgctgagtccgtccggcggctcgccgacctcggcgcgtacggtgtgaccttccacgacgacgacctgatccccttcgggtcgagcgacagcgagcgcgaggcgcacatcaagcgcttccgcgaggcgctggacgccaccggcgtcatcgtgccgatggcgacgaccaacctcttcacccacccggtcttcaaggacggcggcttcaccgccaacgaccgtgacgtgcgccggtacgcgctgcgcaagaccatccgcaacatcgacctggccgtggagctgggcgcgcagacgtacgtcgcctggggcggccgcgagggcgcggagtccggtggcgccaaggacgtgcgcgtcgcgctcgaccggatgaaggaagccttcgacctgctcggcgagtacgtcacggagcagggctacgacctgcgcttcgccatcgagcccaagcccaacgagccccgcggcgacatcctgctcccgacggtcggccacgcgctggcgttcatcgagcgcctggagcgcccggagctgtacggcgtcaacccggaggtcggccacgagcagatggccgggctcaacttcccgcactccatcgcgcaggcgctgtgggcgggcaagctcttccacatcgacctgaacggccagagcggcatcaagtacgaccaggacctgcgcttcggcgccggtgatctgcggtccgcgttctggctggtggacctgctggagacggccggctacgcgggcccgcggcacttcgacttcaagccgccgcggaccgaggacttcgacggcgtgtgggagtcggcggccggctgcatgcgcaactacctgatcctcaaggagcgcgccgcggcgttccgctcggacccggaggtccaggaggcactgcgtgcctcgcgcctggacgagctggcgcggccgacggccgaggacggactggcggcgctgctggccgaccgtaccgcgttcgaggactacgacgtggacgccgccgccgagcgcgggatggcgttcgagcgcctcgaccagctggcgatggaccacctgctcggagcgcgctga

SEQ ID NO: 48 - protein, 389 aa, Streptomyces pristinaespiralis
MTERFTPTPDDKFSFGLWTVGWQGRDPFGDATRPHLDPAESVRRLADLGAYGVTFHDDDLIPFGSSDSEREAHIKRFREALDATGVIVPMATTNLFTHPVFKDGGFTANDRDVRRYALRKTIRNIDLAVELGAQTYVAWGGREGAESGGAKDVRVALDRMKEAFDLLGEYVTEQGYDLRFAIEPKPNEPRGDILLPTVGHALAFIERLERPELYGVNPEVGHEQMAGLNFPHSIAQALWAGKLFHIDLNGQSGIKYDQDLRFGAGDLRSAFWLVDLLETAGYAGPRHFDFKPPRTEDFDGVWESAAGCMRNYLILKERAAAFRSDPEVQEALRASRLDELARPTAEDGLAALLADRTAFEDYDVDAAAERGMAFERLDQLAMDHLLGAR

SEQ ID NO: 49 - DNA, 1170 bp, Roseiflexus sp.
atgagtgacatgtacgaacccaaacccgaacacaaattcaccttcggactctggacggttggcaacatcgggcgtgatccgttcggcgaaccggtgcgccagcctctttcgccggtcgaaatcgtccatctgctggcggaagttggcgcgtatggcgtcaatttccacgacaacgacctgatcccgatcgatgcaacaccggcggatcgcgaccgcattctacgcgagttcaaggcggcgctccaggaaaccggcctcgttgtgccgatggcgacgaccaacctctttgccgatccggtcttcaaggatggcgcctttacctcgaacgatcctaaagtgcgcgcatacgcgctacaaaaaacaatgcgcgcaatcgatctgggcgttgaatgtggcgcgaaggtgtacgttttctggggcggtcgcgaaggcgttgagagtgacgcggcgaaggatccgcaggaagggttgaaacgctaccgcgaagcgatcaatttcctctgcgcctatgtgaaagaccaggggtacgacctgaaattcgcgctcgaacccaagccgaacgagccgcgcggcgacatctatctggcgactgtcgggcacgcgctggcgttcatcaacacgctcgactacccggacatggtcgggctgaacccggaagtcgcccatgaaacaatggcaggactgaacttcctgcacggcgtcgcgcaggcgtgggatgctggcaaactgttccatatcgacctgaacgatcaggtaatcgggcgctacgatcaggatttccgcttcggagcggtcaatctgaaagccgccttcttcctggtgcgcttcctggaaaaggtcgggtaccaggggagtcgtcacttcgatgcacacgcctaccgcaccgaggattatgaaggggtgaaagcgtttgcccgcggctgtatgcgcacctacctgatcttgaaagaaaaggcgcgccgctttgacgaagatgccgagattcaggcgttgctggcggaaatctctgccgacgacggctcgatggcgccgttccagggcggctacagccgcgaaaaggctgccgcgctcaaggcgcatccgttcgaccgggcggcgcttgggcgacgcgggctggcgtatgagcgcctcgatcaactgacgaacgaattgttgctcggcgttcgttaa

SEQ ID NO: 50 - protein, 389 aa, Roseiflexus sp.
MSDMYEPKPEHKFTFGLWTVGNIGRDPFGEPVRQPLSPVEIVHLLAEVGAYGVNFHDNDLIPIDATPADRDRILREFKAALQETGLVVPMATTNLFADPVFKDGAFTSNDPKVRAYALQKTMRAIDLGVECGAKVYVFWGGREGVESDAAKDPQEGLKRYREAINFLCAYVKDQGYDLKFALEPKPNEPRGDIYLATVGHALAFINTLDYPDMVGLNPEVAHETMAGLNFLHGVAQAWDAGKLFHIDLNDQVIGRYDQDFRFGAVNLKAAFFLVRFLEKVGYQGSRHFDAHAYRTEDYEGVKAFARGCMRTYLILKEKARRFDEDAEIQALLAEISADDGSMAPFQGGYSREKAAALKAHPFDRAALGRRGLAYERLDQLTNELLLGVR

SEQ ID NO: 51 - DNA, 1161 bp, Meiothermus ruber
atgtaccagcccagacccgagcataagttcacctttggcctttggacggtaggcaacatcgggcgcgacccctttggcgaggccgtgcgggaacggctcgagcccgactacgtggtgtacaggctggccgagctgggggcctacggggtcaacctgcacgacgaagacctgatcccccgtggcacgcccccggccgagcgcgaggccatcctgcgccgcttcaagaaggccctgcaggacaccggcctcaaggtgcccatggtcaccgccaacctcttctccgacccggcctttaaggacggggccctgaccagccccgacccctgggtgcgggcctacgccctgaagaagagcctcgagaccctcgacctgggcgccgagctgggggcccagatttacgtggtctggccggggcgggagggggccgaggtagacgccaccggcaaggccccgcgggtatgggcctggttccgcgaggccctggacttcatggccgagtatgcggaggagcagggctacaactaccgctttgccctggagcccaaacccaacgagcctcgaggcgacatctacctgcccaccgtgggcagcatgctggccctgatcggcaccctgaagcacccgcaccgctttggcctcaaccccgagttcgcccacgagaccatggccgggctcaacttcgtgcacgcggtggcccaggccctggagatgggcaagctcttccacatcgacctgaacgaccagcgcatgagccgcttcgaccaggatctgcgctttggctcggagaacctcaaggccgcgttcttcctagtggatctgctcgaggccagcggttacgacggcccccgccacttcgacgcccacgccctgcgcaccgaggacgaggccggggtctgggcttttgcccggggctgtatgcgcacctacctgattctgaaggagaaagcccaggccttccgggccgaccccgaggtgaaggctttgctcgaggcctactaccaggccgaccccgagcctttggccctgctgggggcctacagccgggaaaaagctcagcggctcaagcagctcgagctgcccgaggcctgccgcagccgcggttatgccctggagcagctcgaccagctcgccgtagagcacctgctgggggtacggggatga

SEQ ID NO: 52 - protein, 386 aa, Meiothermus ruber
MYQPRPEHKFTFGLWTVGNIGRDPFGEAVRERLEPDYVVYRLAELGAYGVNLHDEDLIPRGTPPAEREAILRRFKKALQDTGLKVPMVTANLFSDPAFKDGALTSPDPWVRAYALKKSLETLDLGAELGAQIYVVWPGREGAEVDATGKAPRVWAWFREALDFMAEYAEEQGYNYRFALEPKPNEPRGDIYLPTVGSMLALIGTLKHPHRFGLNPEFAHETMAGLNFVHAVAQALEMGKLFHIDLNDQRMSRFDQDLRFGSENLKAAFFLVDLLEASGYDGPRHFDAHALRTEDEAGVWAFARGCMRTYLILKEKAQAFRADPEVKALLEAYYQADPEPLALLGAYSREKAQRLKQLELPEACRSRGYALEQLDQLAVEHLLGVRG

SEQ ID NO: 53 - DNA, 1188 bp, Arthrobacter sp.
atgagcgttcagccgacccctgcagaccacttcacctttggcctctggaccgtaggatggaccggcgccgacccattcggtgtcgccacccgcaagaacctggacccggtagaagccgtccacaagctggccgagctcggcgcctacggcatcaccttccacgacaatgacctgattccttttgacgccaccgaggcagagcgcgaaaagatccttggtgacttcaaccaggcgctgaaggacaccggcctgaaggtcccaatggtgaccaccaacctgttcagccacccggtcttcaaggacggcggcttcacctctaacgaccgctcgatccgtcgttttgcactggctaaggtcctgcacaacatcgacttggcagccgagatgggcgccgaaaccttcgtcatgtggggcgggcgcgaaggcagcgaatacgacggttccaaggacctggccgcagcacttgatcgcatgcgcgaaggcgtggacacggcagctggctacatcaaggacaagggttacaacctgcgcatcgcgctggagccaaagccaaatgaaccacgcggcgacatcttcctgcctaccgtcggccacggcctggccttcatcgagcagctggagcacggcgacatcgtcggcctgaacccagaaaccggccacgagcagatggccggcctgaacttcacccacggcatcgctcaggcactgtgggccgagaagctgttccacattgacctcaacggccagcgcggcatcaagtacgaccaggacctggtcttcggccacggcgatctgaccagcgcgttcttcaccgtagacctgctggaaaacggcttccctaacggcggaccaaagtacaccggcccacgccacttcgactacaagccatcgcgcaccgacggctacgacggcgtgtgggactcggccaaggccaacatgtccatgtacctgctgctcaaggaacgtgccctggccttccgtgcggatccagaggtacaggaagccatgaagacctcgggcgtcttcgaactgggcgaaaccaccctgaacgccggggaaagcgcagcggatctgatgaatgattccgcgagcttcgcaggctttgacgccgaggccgccgcagagcgcaacttcgcgttcatccgcctgaaccagctggccatcgagcacctgctcggctcccgctaa

SEQ ID NO: 54 - protein, 395 aa, Arthrobacter sp.
MSVQPTPADHFTFGLWTVGWTGADPFGVATRKNLDPVEAVHKLAELGAYGITFHDNDLIPFDATEAEREKILGDFNQALKDTGLKVPMVTTNLFSHPVFKDGGFTSNDRSIRRFALAKVLHNIDLAAEMGAETFVMWGGREGSEYDGSKDLAAALDRMREGVDTAAGYIKDKGYNLRIALEPKPNEPRGDIFLPTVGHGLAFIEQLEHGDIVGLNPETGHEQMAGLNFTHGIAQALWAEKLFHIDLNGQRGIKYDQDLVFGHGDLTSAFFTVDLLENGFPNGGPKYTGPRHFDYKPSRTDGYDGVWDSAKANMSMYLLLKERALAFRADPEVQEAMKTSGVFELGETTLNAGESAADLMNDSASFAGFDAEAAAERNFAFIRLNQLAIEHLLGSR

SEQ ID NO: 55 - DNA, 1173 bp, Thermobaculum terrenum
atggcagattatacccctaagaagagcgataaatttacctttgggctatggaccgtaggtaatatagggcgagatccctttggtgatcctgtaagaacgcccatgaccccggagcatatagtacataagctcagtgagctcggggcatatggcgtgaactttcatgataacgacctagtgccgtttggagcgtcggcacaggagagagataggatagtcaaaagcttcaagaaggccttggaagataccggtatggtggttcctatggctaccaccaatcttttcacgcaccctatattcaaagatggtgcttttacttcttcagatgccaaggtcagagcatttgctctacaaaagaccatgcaggctatagatctaggagccgagctaggggcgactacttatgtcttctggggaggaagagaaggatccgagaccgatgcctacagaaaccctgtagatgctatcaagcggtttagagaggctattaactatttgtgtgactatgtgatcgatcagggctataacatgcgttttgcactggaacctaaacctaatgaacccagaggagatatttatttccccacagtaggacatatgctacattttatctccactttggatcatcccgagatggtcggtctaaacccagagtttgctcatgagaccatggctggtttgaacttcgtacatgcagtggctgaagctatagaggctggtaagctatttcacatagatctgaatgatcaaataattgggagatatgatcaagatttcagattcgcctctgaaaatcccaagcgagcattcttcttggtgaagctacttgaggacagcggttacgatggccccagacactttgacgcccacgcctacaggaccgaggatgaagaaggtgtttgggcttttgccaggggatgcatgcggtcttatctgatattgaaggagaaggcgcagaagttcaacaaagatgccgaaattcaaggactgctagctgagatcagagctgaagatgaaaactatcaggggccaagtgcttcagacggctactctagggagcatgcgcagcaggtaaaggattataaatttgacgtcactgcactatcgcagcgtggaaggaaatatgaggagctggatcagctagtaatggagctgttgctcggagtaagataa

SEQ ID NO: 56 - protein, 390 aa, Thermobaculum terrenum
MADYTPKKSDKFTFGLWTVGNIGRDPFGDPVRTPMTPEHIVHKLSELGAYGVNFHDNDLVPFGASAQERDRIVKSFKKALEDTGMVVPMATTNLFTHPIFKDGAFTSSDAKVRAFALQKTMQAIDLGAELGATTYVFWGGREGSETDAYRNPVDAIKRFREAINYLCDYVIDQGYNMRFALEPKPNEPRGDIYFPTVGHMLHFISTLDHPEMVGLNPEFAHETMAGLNFVHAVAEAIEAGKLFHIDLNDQIIGRYDQDFRFASENPKRAFFLVKLLEDSGYDGPRHFDAHAYRTEDEEGVWAFARGCMRSYLILKEKAQKFNKDAEIQGLLAEIRAEDENYQGPSASDGYSREHAQQVKDYKFDVTALSQRGRKYEELDQLVMELLLGVR

SEQ ID NO: 57 - DNA, 1170 bp, Janibacter sp.
atgaccacctccgcccacgacttcacgcccacccgtgacgacaagttctcgttcggcctgtggaccgtcggctggcagggcgtcgacgtcttcggcggcgcggtccgccctccgctcgacccggccgaagcggtccacagactctctgaccttggtgcctggggcatcaccttccacgacgacgacgtcatccccttcggggcgagcacccaggagcggctcgaccacctcgcgccgttccgcaaggccctcgccgacaccgggctcgtcgtgccgatggtgacgacaaacctgttctcccaccccgttttccgcgacggtggcttcaccaacaacgaccgcgacgtccgccgctttgcgatcagcaaggtcgccgacaacatcgacctcgccgtcgagctcggtgccacgacgttcgtcgcctggggtgggcgcgagggcgcggagtcgggtgcggccaaggacgtccggtcagccctcgaccgctacaaggaggctttcgacgtcctcggcgcctatgtcctcgagcagggctacgacctcaagttcgctctcgaacccaagcccaacgagcctcgcggcgacatcctgctcccgaccatcggccacgccctcgccttcatcaacgagctcgagcaccccgagctcgtcggcctcaaccccgaggtcggacacgaggagatggccgggctcaactacgcccacggcatcgcccaggcgctgtggcacggcaagctcttccacctcgacctcaacggtcagcacggtccccgcttcgaccaggacctccgcttcggggccggcaacgcccgtggcgccttctggaccgtcgacaccgttgagcagggtggctacgacggcccgcgccacttcgacttcaaaccgccccgcaccgaggacatggacggggtgtgggcgtcggccgccggctgcatgcgcaactacctgatcctgcgcgagaagtcgcgcgccttccgtgtcgacccggaggtccaggcggctctcaaggcctcccgcctcgaccagctcgccacccccaccctgtcgccgggcgagggcctcgatgccctgcgcgcggagagtttcgacccggaggaggcagccgcccgcggcatggccttcgagcacctcgaccagctcgctctcgagcacctctacgggatccggtga

SEQ ID NO: 58 - protein, 389 aa, Janibacter sp.
MTTSAHDFTPTRDDKFSFGLWTVGWQGVDVFGGAVRPPLDPAEAVHRLSDLGAWGITFHDDDVIPFGASTQERLDHLAPFRKALADTGLVVPMVTTNLFSHPVFRDGGFTNNDRDVRRFAISKVADNIDLAVELGATTFVAWGGREGAESGAAKDVRSALDRYKEAFDVLGAYVLEQGYDLKFALEPKPNEPRGDILLPTIGHALAFINELEHPELVGLNPEVGHEEMAGLNYAHGIAQALWHGKLFHLDLNGQHGPRFDQDLRFGAGNARGAFWTVDTVEQGGYDGPRHFDFKPPRTEDMDGVWASAAGCMRNYLILREKSRAFRVDPEVQAALKASRLDQLATPTLSPGEGLDALRAESFDPEEAAARGMAFEHLDQLALEHLYGIR

SEQ ID NO: 59 - DNA, 1194 bp, Brachybacterium faecium
atgaccgcacccacccccacccgtgacgacaagttctccttcggcctgtggaccaccggctggcaggcccaggaccagttcggctccgccacccgcccgccgctggacctcaccgaccacgtgcgcaagctcgccgacctcggcgcctggggcttcaccttccacgacaacgacgtggtgcccttcgatgccacccccgccgagcgcgagcgcatcctcggcgagctgaagaaggtcaccgaggagaccggcctggtgatcgagatggtcaccaccgacaccttcgcccaccccgtcttcaaggacggcgccttcacctccaacgaccgctccgtgcgccgcttcggcctgcgcaaggtgctcgccaacgtggatctcgccgctgagctcggcgcgaccaccttcgtgatgtggggcgggcgcgagggctccgagtacgacggctccaaggacctgctggccgcgcaccagcgctacgccgagggcatcgacaccgtcgccggctacatcaaggacaagggctacgacctgcgcatcggcctcgagcccaagccgaacgagccccgcggcaacatcttcctgcccacgatcggccacgcgctggccttcatcgagcagctcgagcacggcgacatcgtgggcatcaaccccgagaccggccacgagcagatggcgacgctgaactacacccacggcatcgcccaggcgctgtgggcggagaagctcttccacatcgacctcaacggccagcacggcccgatgtacgaccaggacctcgtgttcggccacggcgacctgatcagcgccttcttcaccgtggacctgctcgagaacggcttcccctcgaagccgggcgcctacgagggtgcccgccacttcgacttcaagccctcgcgcaccgagcacgagaagggccagtacgactcggccgccgcgaacatggagatgtacctgatgctcaaggagcgcgccctcgcgttccgtgccgacgccgaggtccaggaagcgctgaagtactccggcatcgaggagctcgccgagccgaccctcgctgcgggcgagaccgtcaccgacctcctcgccgatcgctcctccttcgaggacttcgacgcggacaaggcgggcgagcgcaactacggcttcgtgcgcctgcagcagctggccctccagcacctgctcggcttccgcgcctga

SEQ ID NO: 60 - protein, 397 aa, Brachybacterium faecium
MTAPTPTRDDKFSFGLWTTGWQAQDQFGSATRPPLDLTDHVRKLADLGAWGFTFHDNDVVPFDATPAERERILGELKKVTEETGLVIEMVTTDTFAHPVFKDGAFTSNDRSVRRFGLRKVLANVDLAAELGATTFVMWGGREGSEYDGSKDLLAAHQRYAEGIDTVAGYIKDKGYDLRIGLEPKPNEPRGNIFLPTIGHALAFIEQLEHGDIVGINPETGHEQMATLNYTHGIAQALWAEKLFHIDLNGQHGPMYDQDLVFGHGDLISAFFTVDLLENGFPSKPGAYEGARHFDFKPSRTEHEKGQYDSAAANMEMYLMLKERALAFRADAEVQEALKYSGIEELAEPTLAAGETVTDLLADRSSFEDFDADKAGERNYGFVRLQQLALQHLLGFRA

SEQ ID NO: 61 - DNA, 1182 bp, Beutenbergia cavernae
atgacgcgcacccccacgacccaggacaagttctcgttcggcctgtggacggtcggctggaccggccgcgaccagttcggcgaggccagccgccctgcgctcgacccgtgggactacctcggcccgctcgcggaggccggtgcgtggggcatcacgttccacgacgacgacgtcgtcccgttcggcacgcccgacgccgagcgtgagcagatcctcacgcgcttcaagcaggtggccgacgacgccggtctcgtcatcgagatggtcaccacgaacctgttcagccacccggtgttcaaggacggcggcttcaccgcgaacgaccggggcgtccgtcgcttcgccctgcggaaggtgctgcgcaacgtcgacctcgcggccgagctcggcgcggcgacgttcgtcatgtggggcggccgcgagggcgccgagtacgacggcgccaaggacgtgaacgcggcgctcgaccggtaccgcgagggcatcgacaccgtcgccgcgtacatcaaggagaagggctacgacctgcgcatcgcgctcgagccgaagccgaacgagccgcgcggcgacatcttcctcccgacggtcgggcacgctctcggcttcatcgccgagctcgagcacggcgacatcgtgggcctcaacccggaggtcgggcacgagcagatggccgccctcaactacacccacgggatcgcgcaggcgctgtggagcggcaagctcttccacatcgacctcaacgggcagcgctcgatcaagtacgaccaggacctcgtgttcggccacggcgacctgctgagcgcgttcttcaccgtcgacctgctggagaacggcttcccgtccggcggccctacgtacgacggcccgcgccacttcgactacaagccgtcccgcaccgagggcttcgacggcgtgtgggcgtccgcgcgcgcgaacatggagacgtacctcctgctcgccgagaaggcgcgcgcctatcgcgccgacccacgcgtgcaggaggcgttcgcggcgtccggagtcctggagctcagcgccccgacgctgtccgacggcgagtcgatcgccgacctgctcgcggaccgcggcgcgttcgaggactacgacgctgacgccgccggcgcccgcgagacgaacttcgtggagctgaaccagctcgcgatcgcgcacctcgtcggctga

SEQ ID NO: 62 - protein, 393 aa, Beutenbergia cavernae
MTRTPTTQDKFSFGLWTVGWTGRDQFGEASRPALDPWDYLGPLAEAGAWGITFHDDDVVPFGTPDAEREQILTRFKQVADDAGLVIEMVTTNLFSHPVFKDGGFTANDRGVRRFALRKVLRNVDLAAELGAATFVMWGGREGAEYDGAKDVNAALDRYREGIDTVAAYIKEKGYDLRIALEPKPNEPRGDIFLPTVGHALGFIAELEHGDIVGLNPEVGHEQMAALNYTHGIAQALWSGKLFHIDLNGQRSIKYDQDLVFGHGDLLSAFFTVDLLENGFPSGGPTYDGPRHFDYKPSRTEGFDGVWASARANMETYLLLAEKARAYRADPRVQEAFAASGVLELSAPTLSDGESIADLLADRGAFEDYDADAAGARETNFVELNQLAIAHLVG

SEQ ID NO: 63 - DNA, 1191 bp, Geodermatophilus obscurus
atgaccgcgccgcagcccaccaaggacgaccggttcaccttcggcctctggaccgtcggctggcaggcccgcgacccgttcggcgacgcgacccgcccggcgctcgacccggtggagagcgtgcaccgcctcgccgagctgggcgccgccggcgtcaccttccacgacgacgacctgatcccgttcggcagcgaggacgccgagcgcgccaagcacgtgcagcgcttcacggacgcgctggaggagaccggcctcgtcgtccccatggccacgaccaacctgttcacccacccggtgttcaaggagggcgcgctcaccgccaacgaccgcgacgtccgccggtacgcgctgcgcaaggtcatgcggaacatggacctcgccgccgagctcggcgcgcggacctacgtgctgtggggcggccgcgagggcgccgaggtcgacagcgccaaggacctgcgtgccgcgctcgaccgctaccgcgagggcatcgacaccctggcgcagtactcggaggaccgcggctacgggctgcgcttcgccctggagcccaagccgaacgagccgcgcggcgacatcttcctgccgaccatcggtcacgccctggccttcatctccactctcgagcacgccgacctggtcggcctgaaccccgaggtcggccacgagcagatggccaacctcaactacacgcacggcatcgcccaggcgctgtggcagggcaagctcttccacatcgacctcaacggccagcacgggcccaagttcgaccaggacctggtcttcggccacggcgacctgctcagcgccttcggcaccgtcgacctgctcgagcacggcggcccgaacgggagtccggcctacgacgggccgcggcacttcgactacaagccgctgcgcaccgaggacatcgacggggtgtgggcctcggccgcggccaacatgcgcacctacctgctgctcaaggagcgggcggcggccttccgcgccgacccggaggtgcaggaggcgctggccgccgcccgcgtgcccgagctggcgcagcccacgctggccgacggcgagacgtacgaggacctgctggccgaccgtgcggcgttcgaggagttcgacgcggaggcggccggtgcccgtcccggtggtcaggtgcggctctcgcagctggcggtggagcacctcctcggcgcccgctga

SEQ ID NO: 64 - protein, 396 aa, Geodermatophilus obscurus
MTAPQPTKDDRFTFGLWTVGWQARDPFGDATRPALDPVESVHRLAELGAAGVTFHDDDLIPFGSEDAERAKHVQRFTDALEETGLVVPMATTNLFTHPVFKEGALTANDRDVRRYALRKVMRNMDLAAELGARTYVLWGGREGAEVDSAKDLRAALDRYREGIDTLAQYSEDRGYGLRFALEPKPNEPRGDIFLPTIGHALAFISTLEHADLVGLNPEVGHEQMANLNYTHGIAQALWQGKLFHIDLNGQHGPKFDQDLVFGHGDLLSAFGTVDLLEHGGPNGSPAYDGPRHFDYKPLRTEDIDGVWASAAANMRTYLLLKERAAAFRADPEVQEALAAARVPELAQPTLADGETYEDLLADRAAFEEFDAEAAGARPGGQVRLSQLAVEHLLGAR

SEQ ID NO: 65 - DNA, 1185 bp, Actinoplanes missouriensis
gtgtctgtccaggccacacgcgaagacaagttctccttcggtctctggaccgttggatggcaggctcgtgacgcgttcggtgacgccacgcgtacggcactcgacccggtcgaggccgtgcacaagctcgctgagatcggcgcctacggcatcacgttccacgacgacgacctggtgcccttcggctcggacgcccagacccgcgacggcatcatcgcgggcttcaagaaggcgctcgacgagaccggcctgatcgtcccgatggtgaccaccaacctcttcacccacccggtgttcaaggacggcggcttcaccagcaacgaccgttccgtgcggcgctacgcgatccgcaaggtgctgcgccagatggacctcggcgccgagctgggcgcgaagacgctcgtcctctggggcggccgcgagggcgccgagtacgactcggccaaggacgtcagcgccgccctcgaccgctaccgcgaggcgctcaacctgctcgcgcagtactccgaggaccgcggttacggcctgcgcttcgccatcgagccgaagccgaacgagccccgcggcgacatcctgctcccgaccgccggccacgccatcgcgttcgtgcaggagctggagcgtcccgagctcttcggcatcaacccggagaccgggcacgagcagatgtcgaacctcaacttcacccagggcatcgcccaggcgctgtggcacaagaagctgttccacatcgacctgaacggtcagcacggcccgaagttcgaccaggacctggtcttcggccacggtgacctgctcaacgcgttctcgctggtcgacctcctggagaacggtccggacggcgccccggcgtacgacggaccccgtcacttcgactacaagccgtcccgtaccgaggactacgacggcgtctgggagtcggcgaaggccaacatccggatgtacctgctgctcaaggagcgggccaaggcgttccgcgccgaccccgaggtgcaggaggcgctcgccgccagcaaggtcgcggagctgaagaccccgaccctgaacccgggcgagggatacgccgagctgctcgccgaccgcagcgcgttcgaggactacgacgccgacgccgtgggcgccaagggcttcggcttcgtcaagctgaaccagctcgcgatcgagcacctgctcggagcccgctga

SEQ ID NO: 66 - protein, 394 aa, Actinoplanes missouriensis
MSVQATREDKFSFGLWTVGWQARDAFGDATRTALDPVEAVHKLAEIGAYGITFHDDDLVPFGSDAQTRDGIIAGFKKALDETGLIVPMVTTNLFTHPVFKDGGFTSNDRSVRRYAIRKVLRQMDLGAELGAKTLVLWGGREGAEYDSAKDVSAALDRYREALNLLAQYSEDRGYGLRFAIEPKPNEPRGDILLPTAGHAIAFVQELERPELFGINPETGHEQMSNLNFTQGIAQALWHKKLFHIDLNGQHGPKFDQDLVFGHGDLLNAFSLVDLLENGPDGAPAYDGPRHFDYKPSRTEDYDGVWESAKANIRMYLLLKERAKAFRADPEVQEALAASKVAELKTPTLNPGEGYAELLADRSAFEDYDADAVGAKGFGFVKLNQLAIEHLLGAR

SEQ ID NO: 67 - DNA, 1170 bp, Streptomyces violaceusniger
atgagcttccagcccacccccgaggacaagttcaccttcggtctgtggaccgtcggctggcagggaagggacccgttcggcgacgccacccgccctgccctcgacccggtcgagaccgtgcagcgcctggccgagctgggcgcctacggagtgaccttccacgacgacgacctgatccccttcgggtcgtccgacaccgagcgcgagtcgcacatcaagcggttccgccaggccctggacgccactggcatgacggtgccgatggccaccacgaacctcttcacccaccccgtcttcaaggacggcggtttcaccgccaacgaccgcgacgtgcgccgctacgcgctgcgcaagacgatccgcaacatcgacctggcggccgagctgggcgccaagacgtacgtcgcctggggcggccgtgagggcgccgagtccggtggcgccaaggacgtgcgcgacgccctcgaccgcatgaaggaggcgttcgacctcctgggcgagtacgtcaccgcccagggctacgacctccgcttcgccatcgagcccaagcccaacgagccccgcggcgacatcctcctgcccaccgtcggccacgccctggccttcatcgagcgcctggagcgcccggagctgtacggcgtcaacccggaggtcggccacgagcagatggccggcctgaacttcccgcacggcatcgcgcaggccctgtgggcgggcaagctcttccacatcgacctcaacggccagtccggcatcaagtacgaccaggacctgcggttcggcgccggcgacctgcgggcggcgttctggctggtcgacctcctggagagcgccggttacgagggcccgcggcacttcgacttcaagccgccgcggaccgaggacttcgacggcgtgtgggcctcggccgagggctgcatgcgcaactacctgatcctcaaggagcgcgcggccgccttccgcgccgacccggaggtgcaggaggccctgcgcgccgcgcgtctggaccagctggcccagccgaccgcggcggacggcctggaggccctgctcgccgaccgcaccgcgttcgaggacttcgacgtggaggcggccgccgcgcgcgcggcatggccgttcgaacgcctcgaccagctggcgatggaccacctgctgggcgcgcgcggctga

SEQ ID NO: 68 - protein, 389 aa, Streptomyces violaceusniger
MSFQPTPEDKFTFGLWTVGWQGRDPFGDATRPALDPVETVQRLAELGAYGVTFHDDDLIPFGSSDTERESHIKRFRQALDATGMTVPMATTNLFTHPVFKDGGFTANDRDVRRYALRKTIRNIDLAAELGAKTYVAWGGREGAESGGAKDVRDALDRMKEAFDLLGEYVTAQGYDLRFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLESAGYEGPRHFDFKPPRTEDFDGVWASAEGCMRNYLILKERAAAFRADPEVQEALRAARLDQLAQPTAADGLEALLADRTAFEDFDVEAAAARAAWPFERLDQLAMDHLLGARG

SEQ ID NO: 69 - DNA, 1176 bp, Actinomyces odontolyticus
atgacatccacccccgacaacaagttctccttcggcctgtggacggtcggctggaatgctgtcgaccccttcggcacggggacccgcccggtgctcgacccgtgggagtacacggaaaagctcgcggaggtcggggcgtggggcattaccttccacgacaatgacgtgttcgacttcgacgcgtcggatcaggagcgtcacgaccgcgtcatgaaggtgaaggaggcggcggatgcggctggcctcgtcattgagatggtcacgacgaacacgttcacgcacccggtcttcaaggatggcggcctgacgaacaacgaccgctcgatccgccgtttcggcctgcgtaagatcctgcgcaacgtggatctggctgcggagatgggcgcgacgacgttcgtcatgtggggcggacgcgagggcgcagagtacgactcgtcgaaggacctgaatgcggcattcgaccgctacaaggagggcctggacacggtcgccgcctacatcaagtcgcgcggctacgacctaaagattggcctggagccgaagccgaacgagcctcgcggcgacattttcctgccgacggtcggccacgcgctggcccttatcgcgcagctggagcacggcgacatcgtgggcctgaacccggagacgggccacgagcagatggccggcctgaactacacgcatgcgctggcacaggcgctcaacgcgggcaagctcttccacattgacctcaacggccagtcgggcatcaagtacgaccaggacaaggcgttcggtcacggcgacctggccagcgcgttcttcacggttgacctgctggagaacggcttcccgggcggcggcccgcgctacgagggtccgcgccacttcgactacaagccgagccgcacggagggcatggagggcgtgtgggagtccgcgcgcgcgaacatcgagatgtacctgacgctggcggccaaggcccgcgcgttccgcgaggatccggtcacccaggagctgctcgaggctgcgtcggttcccgagctgggcgaatccacgctggcggcgggcgagtccctcgaggacttcttggcggatcgcagctcctacgaggagttcgacgcgcaggccgccggcgagcgcgagtaccacttcgtggagctgtaccagcaggcgatgcgtcacctgatcggctga

SEQ ID NO: 70 - protein, 391 aa, Actinomyces odontolyticus
MTSTPDNKFSFGLWTVGWNAVDPFGTGTRPVLDPWEYTEKLAEVGAWGITFHDNDVFDFDASDQERHDRVMKVKEAADAAGLVIEMVTTNTFTHPVFKDGGLTNNDRSIRRFGLRKILRNVDLAAEMGATTFVMWGGREGAEYDSSKDLNAAFDRYKEGLDTVAAYIKSRGYDLKIGLEPKPNEPRGDIFLPTVGHALALIAQLEHGDIVGLNPETGHEQMAGLNYTHALAQALNAGKLFHIDLNGQSGIKYDQDKAFGHGDLASAFFTVDLLENGFPGGGPRYEGPRHFDYKPSRTEGMEGVWESARANIEMYLTLAAKARAFREDPVTQELLEAASVPELGESTLAAGESLEDFLADRSSYEEFDAQAAGEREYHFVELYQQAMRHLIG

SEQ ID NO: 71 - DNA, 1179 bp, Mobiluncus mulieris
atggttcgcaaccccaccaaagcagacagattttccttcggtatatggacagttggttggacaggaaccgaccctttcggcacggattctcgtagttcgctagacccttgggaatacgcggataaactggcggaactcggcgcctggggtatcacattccatgacaatgacgtattccccttcaatgccagcgaaacagaaagaaaccaacgagtaaaacggctaaaggatgccgccgacaaggccggcttggtcatcgaaatggtcaccaccaatactttcactcaccccgtgttcaaagatggtggattaacctctaacgatcgagctgtgcgtcgttttggactgcgtaaagtacttaaaaacgtcgacttagcggccgaaatgggcgctaccaccttcgtgatgtggggtggtcgagaaggcgcggaatacgattcctcgaaggatctctacgccgcccacgcccgatatgcggaaggccttgatacagtggcggcctatatcaagcagcaaggctacaatctaaagattggcttggaacccaagcctaatgaaccccggggagatattttcctgccaaccatcggccatgcgctcgccctgattgctaccctggacaacggggacgttgtcggattgaacccagaggtcggccacgaacagatggcgaacctgaactatactcacggcctagctctggcgttgcactccggcaaactagtgcacattgacctcaatggacagaaagggttgaagtacgaccaggacttggtgtttggtcacggcgatttactcagcgctttcttcactgtggatttgctggtaaacggattcccggcctgccccgacgcgcctcgatacaccggaccgatacatttcgattacaaacccagccgcaccgaaggaatgcaaggcgtgtgggaatccgcacaagccaatatgcgcagctatctggccttggcagaaaaagccaaagccttccgcgccgaccccgaggtgcagacactcatgaaggaagcctcggtttacgaactgggcgaaccaactttggacaaagacgaaaacatcgaggactttctggccaaggatgaacccttcgatgtggaagcgaaagcacatcgtgaataccactttgtcaagctctatcagatggctattgaacatctagtgagctga

SEQ ID NO: 72 - protein, 392 aa, Mobiluncus mulieris
MVRNPTKADRFSFGIWTVGWTGTDPFGTDSRSSLDPWEYADKLAELGAWGITFHDNDVFPFNASETERNQRVKRLKDAADKAGLVIEMVTTNTFTHPVFKDGGLTSNDRAVRRFGLRKVLKNVDLAAEMGATTFVMWGGREGAEYDSSKDLYAAHARYAEGLDTVAAYIKQQGYNLKIGLEPKPNEPRGDIFLPTIGHALALIATLDNGDVVGLNPEVGHEQMANLNYTHGLALALHSGKLVHIDLNGQKGLKYDQDLVFGHGDLLSAFFTVDLLVNGFPACPDAPRYTGPIHFDYKPSRTEGMQGVWESAQANMRSYLALAEKAKAFRADPEVQTLMKEASVYELGEPTLDKDENIEDFLAKDEPFDVEAKAHREYHFVKLYQMAIEHLVS

SEQ ID NO: 73 - DNA, 1191 bp, Cellulomonas flavigena
atggttcgcaagcccacccctgaggacaggttctcgttcggtctgtggaccgtggcgtggaacggtcaggaccccttcggctccgccacccgcccgtggctcgacccggtcgagtccgtgcacaagctggccgagctcggcgcctcgcacgtgaccttccacgacgacgacgtcgtcccgttcggctcctcggacgccgaccgcgagaaggtcctcgacggcttccgtgcggcactggccgagaccggcatcacggtcgagatggtcaccaccaacaccttctcgcaccccgtgttcaaggacggcgcgttcacgtccaacgaccgccgcgtgcgccgctacgcgctgcgcaagatcctgcgcaacgtcgacctggccgcgtccctcgacgccgacacgttcgtcatgtggggcggccgcgagggcgccgagtacgactccgccaaggacctgtacgcggcgcaccaggcctacgccgacggcatcgacaccgtcgccgcctacatcaaggagaagggctacaagctgcgcatcgcgctcgagcccaagcccaacgagccccgcggcgacatcctgctcccgacgatcggccacgcgctgggcctcatcgccaagctcgagcacggcgacatcgtcggcctcaaccccgagacgggccacgagcagatggccggcctcaactacacgaccggcctcgcgcaggcgctgtgggcggacaagctgttccacatcgacctcaacggccagcgcggcatcaagtacgaccaggacctggtcttcggccacggtgacctgttctccgcgttcgcgaccgtcgacctcatcgagaacggcttcccgggcggcggcaccaagtacacgggccccgtgcacttcgactacaagccgtcgcgtaccgagagcttcgagggcgtctgggactcggcggccgccaacatggcgacctacatcatcctcaaggagcgtgcgatcgcgttccgccaggaccccgaggtccaggaggccgtggaggcggccggcgtcctcgagctcgccaagcccacgctgaacgagggcgagtcgctggccgacttcctcgcggaccgctccgcgttcgaggagttcgacgccgacgaggtcgccaagcacggcttcggcttcgtgcgcctcaaccagctcgcgctcgagcacgcgctcggcgcccgcggctga

SEQ ID NO: 74 - protein, 396 aa, Cellulomonas flavigena
MVRKPTPEDRFSFGLWTVAWNGQDPFGSATRPWLDPVESVHKLAELGASHVTFHDDDVVPFGSSDADREKVLDGFRAALAETGITVEMVTTNTFSHPVFKDGAFTSNDRRVRRYALRKILRNVDLAASLDADTFVMWGGREGAEYDSAKDLYAAHQAYADGIDTVAAYIKEKGYKLRIALEPKPNEPRGDILLPTIGHALGLIAKLEHGDIVGLNPETGHEQMAGLNYTTGLAQALWADKLFHIDLNGQRGIKYDQDLVFGHGDLFSAFATVDLIENGFPGGGTKYTGPVHFDYKPSRTESFEGVWDSAAANMATYIILKERAIAFRQDPEVQEAVEAAGVLELAKPTLNEGESLADFLADRSAFEEFDADEVAKHGFGFVRLNQLALEHALGARG

SEQ ID NO: 75 - DNA, 1170 bp, Saccharomonospora viridis
gtggtcggcaaacccgtggcagaggacaagttcagtttcggtctgtggacggtgggctggcgggccgccgatccgttcggtgacgcgacgaggcccgagctcgacgtggtcgagacggtgcacaagctggccgaactgggtgcgtggggagtgaccttccacgacaacgacctcattcccttcggcagtgacgagcgtgagcgcgagaagcggatcagccggttccggacggcgctcgacgagaccggactcgtggtgccgatggccaccaccaacctgttcacccaccccgtgttcaaggacggtgcgctcaccagcaacgaccgtgacatccgtcggttcgcgctgcgcaaggtgatgcgcaacatggatcttgcggccgaactcggcgcgacgacgtacgtgttgtggggcggtcgtgagggcagcgagacggacgcggccaaggacgtgcgtgccgcgatggaccgctatcgcgaagggatagacacgctcgcgcagtacgtcgtggagcaaggctacgggctgaggttggcgctggaacccaagccgaacgaaccgcgcggggacatcctgctgcccaccatcgggcatgcgctggcgttcatctccaccttggaacaccacgagatggtggggctcaaccccgaggtcggccacgagcagatggccgggctgaacttcgtgcacggcatcggccaggcgttgtggcagggcaagttgttccacattgacctcaacggccaacacggacctcggtacgaccaggacctcgtgttcggacacggcgacgtgctgtcggcgttctttttggtggacctgctcgaacacggcggatacgacggcccccgacacttcgactacaagccgccgcgtaccgaggacatcgacggtgtgtgggccagcgcggaggccaacatgcggtcgtatctgttgttgcgggagcgggcgaaggccttccgtgccgacccgcgggtgcaggaggcgctggaacgttcccgggtgccggaactggcgcagccgacgttggccgagggggagacggtgtccgatctcaaggccgatcgaaccgcgttcgaggagttcgacgtcgacgccgcggccgcccgcggctacgcctacgcccagttgtcacaactggccttcgaacatctcctgggcgcggcctaa

SEQ ID NO: 76 - protein, 389 aa, Saccharomonospora viridis
MVGKPVAEDKFSFGLWTVGWRAADPFGDATRPELDVVETVHKLAELGAWGVTFHDNDLIPFGSDEREREKRISRFRTALDETGLVVPMATTNLFTHPVFKDGALTSNDRDIRRFALRKVMRNMDLAAELGATTYVLWGGREGSETDAAKDVRAAMDRYREGIDTLAQYVVEQGYGLRLALEPKPNEPRGDILLPTIGHALAFISTLEHHEMVGLNPEVGHEQMAGLNFVHGIGQALWQGKLFHIDLNGQHGPRYDQDLVFGHGDVLSAFFLVDLLEHGGYDGPRHFDYKPPRTEDIDGVWASAEANMRSYLLLRERAKAFRADPRVQEALERSRVPELAQPTLAEGETVSDLKADRTAFEEFDVDAAAARGYAYAQLSQLAFEHLLGAA

SEQ ID NO: 77 - DNA, 1188 bp, Streptomyces lividans
atgaactaccagcccacttccgaggacaggttcacgttcggtttgtggacggtcggctggcagggcctggacccgttcggtgacgccaccagggaggccctggaccccgccgagtcggtacggcgtctgtcccagctgggtgcgtacggcgtcacgttccacgacgacgagctgatccccttcgggtcgagcgacaacgagcgcggagtcgcacacggagcgggagtcgcacatcaagcggttccggcaggcgctggacgcgaccggcatgaaggtgccgatggcgacgacgaacctgttcacgcacccgggtgttcaagggacggcgccttcacggcgaacgaccgggacgtgcgaggtacgcgctgcgcaagagcgatccgcaacatcgacctcgcggtcgagcatgtggcgcgagcgtctacgtgcgcctggggcggccgggagggtgcggagtccggcgcggccaaggacgtgcgggacgcgctcgaccggatgaaggaggccttcgacctgctgggcgagtacgtcaccgagcagggctacgacctgaagttcgcaatcgagccgaagcccaacgagccgcgcggtgacatcctgctcccgacggtcggacacgccctcgccttcatcgagcgcctcgagcggccggaactgtacggcgtgaacccggaggtcggccacgagcagatggccggcctgaacttcccccacggcatcgcccaggcgctgtgggcgggcaagctcttccacatcgacctcaacggccagtcgggcatcaagtacgaccaggacctgaggttcggcgcgggcgacctgcgggccgcgttctggctcgtcgacctgctggagcgggccgggtacgcgggtccgcggcacttcgacttcaagccgccgcggaccgagaacttcgacgccgtgtggccgtcggccgccggctgcatgcgcaactacctgatcctcaaggaccgggcggcggcattccgcgccgacccgcaggtgcaggaggcgctggccgcggcccggctggacgaactggcccgcccgaccgccgaggacggtctcgccgccctgctggccgaccggagcgcctacgacaccttcgacgtggacgcggccgccgcgcgaggcatggcgttcgagcacctcgaccagctcgccatggaccacctcctcggcgcccgctga

SEQ ID NO: 78 - protein, 395 aa, Streptomyces lividans
MNYQPTSEDRFTFGLWTVGWQGLDPFGDATREALDPAESVRRLSQLGAYGVTFHDDELIPFGSSDNERGVAHGAGVAHQAVPAGAGRDRHEGADGDDEPVHAPGCSRDGAFTANDRDVRGTRCARAIRNIDLAVEHVARASTCAWGGREGAESGAAKDVRDALDRMKEAFDLLGEYVTEQGYDLKFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLERAGYAGPRHFDFKPPRTENFDAVWPSAAGCMRNYLILKDRAAAFRADPQVQEALAAARLDELARPTAEDGLAALLADRSAYDTFDVDAAAARGMAFEHLDQLAMDHLLGAR

SEQ ID NO: 79 - DNA, 1218 bp, Frankia sp.
atgccacgacagcccactcccgaggacaagttctccttcggcctgtggacggtcggctggaccggcaccgacccgttcggcctgccgacccggacggccctcgacccgtgggagtacgccgaccggctggccgagataggcgcctggggcatcaccctgcacgacaacgacgtcttccccttcgacgccgatgacgccgccgccgcgcgggcgtcccgccggctcaaggaggccaccgacgcctccggcctggtcatcgagatggtgaccacgaacaccttcacccatcccgtcttcaaggacggcggcctgacctcgaacgaccgcggcgtgcgccggttcggcctgcgcaaggtgctgcgcgcggtggatctcgcggcgcagctcggcgcgaccacgttcgtgatgtggggcggccgggagggcagcgagtacgacgggtcgaaggacgtcttcgccgcgctggagcgctaccgggagggcctggacaccgtcgccggctacatcaaaagccagggctacgacctgcggatcgcgctcgaacccaagccgaacgagccgcgcggcgacatcctcctgcccaccgtcgggcatgcgctggcgctgatcgccgagctggagaacggcgacatcgtcggggtcaacccggagaccgggcacgagcagatggccaacctcaactacacccacgcgctcggccaggcactgtggagcgggaagctgttccacatcgacctcaacgggcagcggggcctgaagtacgaccaggacctggtcttcgggcacggcgatctcgtctcggcgttcttcaccgtcgacctgctcgagaacggcttcccgggctacccggacggcccccggtacaccggtccccgccacttcgactacaagccgtcgcggacggagggcatggccggggtctgggagtcggcgcgggcgtgcatgtcgacctacctgctgctcgccgagaaggtggcggcgttccgcgccgatcccctcgtccaggaggcgatggcctacgccggcgtgttcgagctggccaagcccaccctcgcccccggcgagaccgcggccgatctcctggcctcggacgacggcttcgacccggccaaggcggccgagcgggacttcggtttcgtgcggctccagcaactggcgatcgagcatctcgtcggctcgcccgccccgggctcggcagccgcccgttccgccggctga

SEQ ID NO: 80 - protein, 405 aa, Frankia sp.
MPRQPTPEDKFSFGLWTVGWTGTDPFGLPTRTALDPWEYADRLAEIGAWGITLHDNDVFPFDADDAAAARASRRLKEATDASGLVIEMVTTNTFTHPVFKDGGLTSNDRGVRRFGLRKVLRAVDLAAQLGATTFVMWGGREGSEYDGSKDVFAALERYREGLDTVAGYIKSQGYDLRIALEPKPNEPRGDILLPTVGHALALIAELENGDIVGVNPETGHEQMANLNYTHALGQALWSGKLFHIDLNGQRGLKYDQDLVFGHGDLVSAFFTVDLLENGFPGYPDGPRYTGPRHFDYKPSRTEGMAGVWESARACMSTYLLLAEKVAAFRADPLVQEAMAYAGVFELAKPTLAPGETAADLLASDDGFDPAKAAERDFGFVRLQQLAIEHLVGSPAPGSAAARSAG

SEQ ID NO: 81 - DNA, 1152 bp, Streptosporangium roseum
atgagcgactacacgcccaagcctgaggaccgcttcaccttcgggctgtggaccgtcggctggcaggcccgtgaccagttcggagacgcgagccgtgccccgctcgacccggtggagagcgtccaccgcctcgccgagctcggcgcgtacggcgtcaccttccacgacgacgacctgctggccgtcgagccggaccgggacaaggccgtcgagcgtttcaagaaggccctggccgagaccggcctcaaggtccccatggccaccacgaacctgttcacccaccccgtcttcaaggacggcgggttcaccagcaacgaccgcgacgtgcgccgctacgccctgcgcaaggtgatgcgcaacgtcgacctggcagccgagctcggcgcgaccacctacgtctgctggggcggccgcgagggcgccgagtcaggggccgccaaggacatcagggccgcgctcagccgttacaaggagggcatggacctgctgacctcctacgtgatcgaccggggctacgacatcaggttcgccatcgagcccaagccgaacgagccgcgcggcgacatcctgctcccgaccgtcggccacgcgctcgccttcatcaacgagctggagcactccgagcgggtcggcctcaacccggaggtcggccacgaggagatggccgggctcaacttcgcgcacggcatcgcgcaggcgctctggcacggcaagctcttccacatcgacctcaacggccagcacggcccccggttcgaccaggacctcgtcttcggccacggcgacgtgaagaactccttcttcctggtggacctgctggagaacggcggctacgacggcccccggcacttcgactacaagccgctgcgcaccgaggacgccgaggacgtctgggtctcggccgcggccaacatgcgcacctacctgatcctcaaggagaaggtgaaggccttccacgccgaccccgaggtcgtcgaggcgcgcgccgccagcagggtcgccgagctgtccgagcccacgctggcccccggtgagacgcttgaggacctgcaccgcgacgacttcgacgtcgaccgggccgccgcgcgaggcttccacttctcccggctgaaccagctcgccctggagcacctcctcggagtccggggatga

SEQ ID NO: 82 - protein, 383 aa, Streptosporangium roseum
MSDYTPKPEDRFTFGLWTVGWQARDQFGDASRAPLDPVESVHRLAELGAYGVTFHDDDLLAVEPDRDKAVERFKKALAETGLKVPMATTNLFTHPVFKDGGFTSNDRDVRRYALRKVMRNVDLAAELGATTYVCWGGREGAESGAAKDIRAALSRYKEGMDLLTSYVIDRGYDIRFAIEPKPNEPRGDILLPTVGHALAFINELEHSERVGLNPEVGHEEMAGLNFAHGIAQALWHGKLFHIDLNGQHGPRFDQDLVFGHGDVKNSFFLVDLLENGGYDGPRHFDYKPLRTEDAEDVWVSAAANMRTYLILKEKVKAFHADPEVVEARAASRVAELSEPTLAPGETLEDLHRDDFDVDRAAARGFHFSRLNQLALEHLLGVRG

SEQ ID NO: 83 - DNA, 1164 bp, Nocardioides sp.
atgaccgagtcgagcttcagccccacgcgcgacgaccacttcaccttcggcctgtggaccgtggggtggcagggcgtcgacgtcttcggcaccgcgatccgcccggtcctcgagccggccgaggcgatccaccggctcagcgacctcggcgcgtacggcgtgacgttccacgacaacgacgtgttccccttcgacgcggacgccaccaccaaggagcagcacctcgcaccgttccgcaaggcgctcgaggagaccggcctggtggtccccatggtcaccacgaacctgttctcccacccggtgttccgcgacggcggcttcaccaacaaccaccgcgacgtacgccggttcgcgatccgcaaggccgccgaccagatcgatctggccgccgagctcggcgccaagatcttcgtcgcctggggcggccgcgagggagccgagtcgggggcggcgaaggacatcaagtcggcgctgtcgcgctacaaggaggccttcgacctgctcggcgcctacgtgctggagcagggctacgacctgcgcttcgcgatcgagcccaagcccaacgagccgcgcggcgacatcctgctgccgaccgtcggccacgccctggcgttcatcaacgagctcgagcaccccgagctggtcggcctcaaccccgaggtcgggcacgaggagatggcgtccctgaactacgcgcacggcctggcccaggcgctgtggcacggcaagctcttccacatcgacctcaacggccagcacggcccccgctacgaccaggacctccgcttcggcgccggcaacgcacgcggcgcgttctggaccgtcgacatcgtcgagaacggcggctacgagggcccgcggcacttcgactacaagccaccgcgcaccgaggacatggacggtgtctgggtctccgccgaggcgtgcatgcgcaactacctgatcctgcgcgagaaggtacgtgccttccgcgccgaccccgaggtgcagcaggccctgaaggacgcccgggtcgaccagctcgcggtcccgaccgtggccgccggcgagtcgctcgccgacctgcgcgccgaggcgttcgatcccgaccaggccgcccagcgtggcatgggcttcgagaagctcgaccagctcgccctggagcacctgtacggcgtgcgctga

SEQ ID NO: 84 - protein, 387 aa, Nocardioides sp.
MTESSFSPTRDDHFTFGLWTVGWQGVDVFGTAIRPVLEPAEAIHRLSDLGAYGVTFHDNDVFPFDADATTKEQHLAPFRKALEETGLVVPMVTTNLFSHPVFRDGGFTNNHRDVRRFAIRKAADQIDLAAELGAKIFVAWGGREGAESGAAKDIKSALSRYKEAFDLLGAYVLEQGYDLRFAIEPKPNEPRGDILLPTVGHALAFINELEHPELVGLNPEVGHEEMASLNYAHGLAQALWHGKLFHIDLNGQHGPRYDQDLRFGAGNARGAFWTVDIVENGGYEGPRHFDYKPPRTEDMDGVWVSAEACMRNYLILREKVRAFRADPEVQQALKDARVDQLAVPTVAAGESLADLRAEAFDPDQAAQRGMGFEKLDQLALEHLYGVR

SEQ ID NO: 85 - DNA, 1161 bp, Kribbella flavida
atgaccggttttaccccgagcaaggccgacaagttctccttcggcttgtggacggtcggctgggaaggcgtcgacgtcttcggtacggcggtccgcgcgccgctcgacccggtgctggcggtggagaagctggccgagctgggtgccgccgcgatctcgttccacgacgacgacctggtcccggacgacgcgcagcgccggcaggtgctcgagcggttcaccaaggcgctggccgacaccgggatggtggtcgagatggccaccacgaacctgttcgcccacccggtgttcaaggacggcggcctgaccgcgaacgaccgcgacgtccgccggtacgcgctcgcgaaggtgctgcgcaacgtcgacctggccgccgagctgggcgcgacgacgtacgtgctgtggggcggccgggagggctcggagtcgggcggttccaaggacgtcggcgccgcgctggaccggtacaaggagtcgatggacctgctcacgacgtacgtgcgcgagcagggctacgacctgcggttcgcactggagccgaagccgaacgagccgcgcggcgacatcttgctgccgacgatcgggcacgcgatcgcgttcatcaacgacctggagcaccccgagctggtcggcatcaaccccgaggtcgggcacgagcagatggcggggctgaactacgcccacggcatcgcccaggcgctgtggcacggcaagctgttccacatcgacctgaacgggcagcacgggccgcggttcgaccaggacctgcgcttcggcgccggcaacctgcgggaggcgttctggactgtggacgtgctgcagggctcgcagggccggcccgggtacgacgggtacgtgcacttcgactacaagccgccgcgcaccgaggacctggacggcgtctgggagaccgcgcgcggctgcatgcgcaactacctggtcctgcgggagaaggtggccgcgttccgggccgacccggaggtcgccgaggccctcgccgcggcgcgggtggccgacctgtccgagccgacgctcggcgcgggggagtcgctcgacgacctgcgcaaggcgtcgtacgacccggacgcgctggctcagcggggcctcgggttcgagcggctcgaccagctcgcgatggatcacctgctgggtattcgataa

SEQ ID NO: 86 - protein, 386 aa, Kribbella flavida
MTGFTPSKADKFSFGLWTVGWEGVDVFGTAVRAPLDPVLAVEKLAELGAAAISFHDDDLVPDDAQRRQVLERFTKALADTGMVVEMATTNLFAHPVFKDGGLTANDRDVRRYALAKVLRNVDLAAELGATTYVLWGGREGSESGGSKDVGAALDRYKESMDLLTTYVREQGYDLRFALEPKPNEPRGDILLPTIGHAIAFINDLEHPELVGINPEVGHEQMAGLNYAHGIAQALWHGKLFHIDLNGQHGPRFDQDLRFGAGNLREAFWTVDVLQGSQGRPGYDGYVHFDYKPPRTEDLDGVWETARGCMRNYLVLREKVAAFRADPEVAEALAAARVADLSEPTLGAGESLDDLRKASYDPDALAQRGLGFERLDQLAMDHLLGIR

SEQ ID NO: 87 - DNA, 1170 bp, Roseiflexus castenholzii
atgagcgacatgtacgaacccaaacccgaacacaagttcactttcggtctctggacggtcggcaatatcggacgtgacccgttcggcgagccggtgcgccatccgctctcgccggtcgagattgtccatctcctggcggatgtcggcgcgtatggcgtcaattttcacgataacgacctgattccgattgatgcaacgccagccgaccgtgatcgtatcctgcgtgagttcaaggcggcgttacaagaaaccgggcttgtcgtgcccatggcgacgacgaacctcttcgccgatccggtcttcaaggatggcgcatttacgtcaaacgacccaaaggtgcgcgcctatgcgctgcaaaagaccatgcgcgccatcgacctgggagtcgaatgcggcgcaaaggtgtatgtcttctggggcggacgcgagggagtggagagcgatgccgcaaaggacccgcaggaagggctgaagcgctatcgtgaggtaatcaactttctctgcgcctatgtcaaagatcaggggtacgacctgaaattcgcactcgaaccaaaaccgaacgagccgcgcggcgacatctacctggcgaccgtcgggcatgcactggcgttcatcaacacgctcgaccaccccgacatggtcgggctgaacccggaagtcgcgcacgaaacaatggcggggctgaacttcctgcacggcgttgcgcaggcatgggacgccggcaaactgttccatatcgacctgaacgatcaggtgatcgggcgctacgatcaggacttccgctttggcgcggtgaatctgaaagcagcgttctttctggtgcgcttcctggagaatgtcggttaccagggaagccgtcacttcgatgcgcacgcctaccgcactgaggattacgaaggggtcaagacgtttgcgcgcggctgtatgcgcacctacctgatcctgaaagaaaaggcgcgtcgtttcgacggggatgccgaaattcaggcgctgctcgcggaaatcacagctgacgacggcacgatggcgccgtttcagggtggctacagccgcgacaaggcggatgcactcaaggcgcatccgttcgatcgcgtcgcgttggggcggcgcgggctggcgtatgagcgtctcgaccaactgaccaacgagttgctgctgggtgtacgctaa

SEQ ID NO: 88 - protein, 389 aa, Roseiflexus castenholzii
MSDMYEPKPEHKFTFGLWTVGNIGRDPFGEPVRHPLSPVEIVHLLADVGAYGVNFHDNDLIPIDATPADRDRILREFKAALQETGLVVPMATTNLFADPVFKDGAFTSNDPKVRAYALQKTMRAIDLGVECGAKVYVFWGGREGVESDAAKDPQEGLKRYREVINFLCAYVKDQGYDLKFALEPKPNEPRGDIYLATVGHALAFINTLDHPDMVGLNPEVAHETMAGLNFLHGVAQAWDAGKLFHIDLNDQVIGRYDQDFRFGAVNLKAAFFLVRFLENVGYQGSRHFDAHAYRTEDYEGVKTFARGCMRTYLILKEKARRFDGDAEIQALLAEITADDGTMAPFQGGYSRDKADALKAHPFDRVALGRRGLAYERLDQLTNELLLGVR

SEQ ID NO: 89 - DNA, 1188 bp, Arthrobacter aurescens
atgaccccgcagcccaccccgcaggaccgcttcacctttggcctctggaccgtcggctggaccggcgccgatccgttcggcgtagccacccgcccggcgctggacccggtggaagcagtccacaagctcagcgagcttggcgcctacggcatcacgttccacgacaatgacctggtccccttcgacgccacggcgtccgagcgcgacctcatcctgaagaacttcaaggcagcgttggccgagaccggactgaagacgcccatggtcaccacaaacctgttcagccaccctgtgttcaaggatggcgggttcacctcgaacgaccgttccatccgccgctttgccctgagcaagatcctccggaacatcgatctcgctgctgaactgggtgccgagaccttcgtgatgtggggcggccgcgaaggcagcgaatacgacggctccaaggatctttccgcagccctggatcgcatgaaggaaggcgtggacaccgcggccggctacatcaaagagaagggctacggcctgcgcatcgcccttgagcccaagccgaacgaaccccgcggcgacatcttcctgcccaccgtgggccatggcctggcgttcatcgcacagctggaacacggcgacatcgtaggccttaacccggaaacgggccacgagcagatggccgggttgaacttcacccacggcattgcacaggccctgtgggcgggcaagctcttccacatcgacctcaacggccagcgcgggatcaagtacgatcaggaccttgttttcggccacggcgacctcaccagcgccttcttcaccgtggaccttctggagaatggcttccccaacggcggaccaaagtacgacggtccgcgccacttcgactacaagccctcccgcaccgatggttacgacggcgtgtgggaatcagccaagtccaacatgtccatgtacctcctgctgaaggaacgcgcactggccttccgcgcggaccccgaggttcaggaagcactcgccacctcaggcgtcttcgaactgggcgaacccacgttgaacgctggagagaccacggcggatctgctggccgacgccagcgccttcgacacgttcaacgccgatcaggccgccgagcgctcgttcgccttcgtccgcctcaaccagctggccatcgagcacctgctcggcgcccgctag

SEQ ID NO: 90 - protein, 395 aa, Arthrobacter aurescens
MTPQPTPQDRFTFGLWTVGWTGADPFGVATRPALDPVEAVHKLSELGAYGITFHDNDLVPFDATASERDLILKNFKAALAETGLKTPMVTTNLFSHPVFKDGGFTSNDRSIRRFALSKILRNIDLAAELGAETFVMWGGREGSEYDGSKDLSAALDRMKEGVDTAAGYIKEKGYGLRIALEPKPNEPRGDIFLPTVGHGLAFIAQLEHGDIVGLNPETGHEQMAGLNFTHGIAQALWAGKLFHIDLNGQRGIKYDQDLVFGHGDLTSAFFTVDLLENGFPNGGPKYDGPRHFDYKPSRTDGYDGVWESAKSNMSMYLLLKERALAFRADPEVQEALATSGVFELGEPTLNAGETTADLLADASAFDTFNADQAAERSFAFVRLNQLAIEHLLGAR

SEQ ID NO: 91 - DNA, 1155 bp, Leifsonia xyli
ttgctggctcgagcgcaggctccaccggagctgagcagccgcggcgcgacccggccaccgctcgacgtcgtggaggcggtgacgaggctgagcgagctgggcgcttatgggctcaccttccacgatgacgacctgttcgcgttcggctcggccgacgcggagcggcagaagcaaatcgaccggctgaagcaggcgctcgcggacaccgggatcatcgtgccgatggtcacaacgaatctgttcagcgccccggtgttcaaagacggcggcttcacctccaacgaccgcgccgtgcgccggttcgcgctgcggaaggcgctgaggaacctcgacctcgccgccgagctgggggcgcagacgttcgtgctgtggggtggccgcgaaggggcggagtacgactccgcgaaagaaatccggatggcgctggaacgctatcgcgaggccgtcgatctgctcggcgactatgtcaccggcaagggctacggcatccggttcgccctggagccgaagccgaacgagccgcgcggcgacattctgctcccgaccatcggccacgcgctcgcgttcatctcgtcgctggagcggccggagctggtggggctcaacccggaggtcgggcacgagcagatggccgggctcaacgccgccgccggagtcgctcaggcgctgtatcacagcaagctcttccacatcgacctcaatgggcagcgcggcgtcaagtacgaccaggatctggtgttcgggcatggcgatctgcagaacgccttcgccctggtcgacttgctggagaacggcggcccggcctacggcggcccggcctacgacggcccgcgccacttcgactcccagacgcccgcaccgaggacgtcgcgggcgtctgggagtcggcggccgcgaacatgcgcacctaacctgctgctgaaggagcgcgcggcgtcgttccgcgccgaccccgacgtgcaggaagcgctggccgcgtcgcgcgtcgcggagctgtcgcagccgacactcggcccgagcgagagctacggggacctgctggccgactgcagcgcgttcgaggacttcgacgcggacgcctatttcggtggcaggggcttcggcttcgtgcggcttcagcagctggccctcgagcatctgctcggcgcgcgctga

SEQ ID NO: 92 - protein, 384 aa, Leifsonia xyli
MLARAQAPPELSSRGATRPPLDVVEAVTRLSELGAYGLTFHDDDLFAFGSADAERQKQIDRLKQALADTGIIVPMVTTNLFSAPVFKDGGFTSNDRAVRRFALRKALRNLDLAAELGAQTFVLWGGREGAEYDSAKEIRMALERYREAVDLLGDYVTGKGYGIRFALEPKPNEPRGDILLPTIGHALAFISSLERPELVGLNPEVGHEQMAGLNAAAGVAQALYHSKLFHIDLNGQRGVKYDQDLVFGHGDLQNAFALVDLLENGGPAYGGPAYDGPRHFDSQTPAPRTSRASGSRRPRTCAPNLLLKERAASFRADPDVQEALAASRVAELSQPTLGPSESYGDLLADCSAFEDFDADAYFGGRGFGFVRLQQLALEHLLGAR

SEQ ID NO: 93 - DNA, 1179 bp, Jonesia denitrificans
atgacgcagcaggacatcaaatactccttcggtctgtggacaaccggatggcaaggccgcgaccagttcggtgacgccacccgtgcatttcgcagcccagccgacgacgtccgcaaacttgcggaactcggtgcgtggggtttcaccttccacgacgacgatgtcgtcccttttggttcagatgatgcaacccgcgccaagctcctcggcgaggtcaaggacgcagcgcaggaaacgggtctcaccatcgagatggtgaccaccaacctcttctcccaccccgtcttcaaagacggtggcgtcacatccaatgaccgctccgtgcgccgtttcgcgctgcgcaaggtgctccgcaacgtggacctgaccgcagaactgggcgccaaaaccttcgtcatgtggggtggccgtgaaggctccgagtacgacggtgccaaggacctccacgcagcccttgagcggtacaaggaaggtgtcgacctcatcgcggggtacatcaaggagaagggctacgacatcaagatcgcccttgagcctaagcccaacgaacctcgcggggacatcttcttgcccaccgttggtcacgcactcggcttcatcgcggaactcgaacacggggacatcgttggtttgaaccccgagactggtcacgagcaaatggctggcctcaactacactcacggtctggcacaggctctgtgggctgacaaactcttccacatcgacctcaacggtcagcgttccatcaagtttgaccaggaccttgtttttggtcacggagacttgttgtctgcgttcttcaccgtggacttggtggaaaacgggttccctgcctccccagacgctccccgctacaccggcccacgtcactttgactacaagccaagccgcaccgaagcggttgagggcgtgtgggactccgcaaaagccaacatggagacctacaaccttctggcggcgaaggccaaggcctaccgtgaggaccctgaggttaaggcagcaatggagcaggctggcctgtttgagctggcaacacccacccttgctgcaggtgaatcggtggctgaccttcttgctgacacatccgcgttcgaagacttcgacgctgatgcagcagcggagcgttccttcgggttcgtgcgcctcaaccagcttgcgatcaagcacctgattggctga

SEQ ID NO: 94 - protein, 392 aa, Jonesia denitrificans
MTQQDIKYSFGLWTTGWQGRDQFGDATRAFRSPADDVRKLAELGAWGFTFHDDDVVPFGSDDATRAKLLGEVKDAAQETGLTIEMVTTNLFSHPVFKDGGVTSNDRSVRRFALRKVLRNVDLTAELGAKTFVMWGGREGSEYDGAKDLHAALERYKEGVDLIAGYIKEKGYDIKIALEPKPNEPRGDIFLPTVGHALGFIAELEHGDIVGLNPETGHEQMAGLNYTHGLAQALWADKLFHIDLNGQRSIKFDQDLVFGHGDLLSAFFTVDLVENGFPASPDAPRYTGPRHFDYKPSRTEAVEGVWDSAKANMETYNLLAAKAKAYREDPEVKAAMEQAGLFELATPTLAAGESVADLLADTSAFEDFDADAAAERSFGFVRLNQLAIKHLIG

SEQ ID NO: 95 - DNA, 1167 bp, Streptomyces olivaceoviridis
atgagctaccagcccacccccgaggacaggttcacgttcggactctggaccgtcggctggcagggaagggacccgttcggcgacgccacccgccgcgccctcgacccggtcgagacggtgcagcgcctggcggaactcggtgcccacggagtgaccttccacgacgacgacctgatccccttcggttcgtcggacaccgagcgcgagtcgcacatcaagcggttccgccaggccctggacgccaccggcatgaccgttccgatggccaccacgaacctcttcacgcaccccgtcttcaaggacggcgcgttcacggccaacgaccgcgacgtgcgccgctacgccctccgcaagacgatccgcaacatcgacctggcggccgagctgggcgcgaagacgtacgtcgcctggggtggccgcgagggcgccgagtccggtgccgccaaggacgtgcgttccgccctggaccgcatgaaggaggccttcgacctcctcggcgagtacgtcacctcgcagggctacgtcctccgcttcgccatcgagcccaagccgaacgagccccgcggcgacatcctgctgcccaccgtcgggcacgcgctggccttcatcgagcgcctggagcggcccgagctctacggcgtcaaccccgaggtcggccacgagcagatggccggcctgaacttcccgcacggcatcgcgcaggccctgtgggccgggaagctgttccacatcgacctcaacggccagtccggcatcaagtacgaccaggacctgcggttcggcgcgggcgacctgcggtccgcgttgtggatggtcgacctcctggagagcgccggttacgaaggaccgcgccacttcgacttcaagccgccgcggaccgaggacctcgacggcgtgtgggcctcggcagcgggctgcatgcgcaactacctcattctgaaggagcgcgcggcagccttccgtgccgaccccgaggtgcaggaggcgctgcgcgcctcgcgcctggaccagctggcccagccgaccgcggccgacggcctggaggacctgctcgccgaccgcgcggccttcgaggacttcgacgtggaggccgccgccgcgcgcggcatggccttcgaacgcctcgaccagctggcgatggaccacctgctgggcgcgcggggctga

SEQ ID NO: 96 - protein, 388 aa, Streptomyces olivaceoviridis
MSYQPTPEDRFTFGLWTVGWQGRDPFGDATRRALDPVETVQRLAELGAHGVTFHDDDLIPFGSSDTERESHIKRFRQALDATGMTVPMATTNLFTHPVFKDGAFTANDRDVRRYALRKTIRNIDLAAELGAKTYVAWGGREGAESGAAKDVRSALDRMKEAFDLLGEYVTSQGYVLRFAIEPKPNEPRGDILLPTVGHALAFIERLERPELYGVNPEVGHEQMAGLNFPHGIAQALWAGKLFHIDLNGQSGIKYDQDLRFGAGDLRSALWMVDLLESAGYEGPRHFDFKPPRTEDLDGVWASAAGCMRNYLILKERAAAFRADPEVQEALRASRLDQLAQPTAADGLEDLLADRAAFEDFDVEAAAARGMAFERLDQLAMDHLLGARG

SEQ ID NO: 97 - DNA, 1173 bp, Stackebrandtia nassauensis
atgagcgacaagtacacacccgtgccggacgacaagttctccttcgggatctggacggtcggctgggccgcccaggacgtgttcggccccgcgacccgcgcccccatgcccgccgaccgcgcggtccacaaactcgccgagatcggcgcctacggggtcaatttccacgacaacgacgtgttcgacttcgacgaccccgaaaccgtccgcgacgccaagatcgccgccttccgcaaggccctcgacgcgaccggcctcaaggtcaccaccgccaccacgaacctgttcagccacccgatcttcaaggacggcgccttcacccacaacgaccgcgacgtgcgccgcttcgccctcgccaaggtcatgcgcaacctcgacctggccgccgaactgggagccggggtctacgtgtgctggggcggccgcgaaggcgcggaatccggcggcgccaagaacatccaggccgccctcgaccggatgaaggaagccttcgacatcctcggggcctacgtcaccgaccagggctacgacacccgcttcgccatcgaacccaaacccaacgagccgcgcggccacatcctcctgcccaccgtcggccacgccctggccttcatcaacgaactcgaatactccgaccgggtcggcgtcaaccccgagatcggccacgaggagatggccggactcgactacgccgccggaatccgccaagccctgtggcacggcaaactgttccacatcgacctcaacggccagaccggtccccgctacgaccaggacctgcgcttcggcgcgggcaacgtcggcggcgccttctgggccgtcgacgccatcgaggagggcatcgccaacggccagtactccggcccgatccacttcgacttcaaacccccacgcaccgaggacgacgacggcgtctgggtcgccgcggccgcctgcatgcgcaactacaagatcctgcgcgacaaggtccacacattccgctccgacccacgggtacgagaagccctcgaagccgcgcgggtcgaccaactcaccgtcccgaccctggccaagggcgaaacctgggcctccataaaagacctcacggtcgacgtcgcgggtctggccgcccggggcatggccttcgaacgactcgaccagctggccctggaacacctctacggcgtcgggtag

SEQ ID NO: 98 - protein, 390 aa, Stackebrandtia nassauensis
MSDKYTPVPDDKFSFGIWTVGWAAQDVFGPATRAPMPADRAVHKLAEIGAYGVNFHDNDVFDFDDPETVRDAKIAAFRKALDATGLKVTTATTNLFSHPIFKDGAFTHNDRDVRRFALAKVMRNLDLAAELGAGVYVCWGGREGAESGGAKNIQAALDRMKEAFDILGAYVTDQGYDTRFAIEPKPNEPRGHILLPTVGHALAFINELEYSDRVGVNPEIGHEEMAGLDYAAGIRQALWHGKLFHIDLNGQTGPRYDQDLRFGAGNVGGAFWAVDAIEEGIANGQYSGPIHFDFKPPRTEDDDGVWVAAAACMRNYKILRDKVHTFRSDPRVREALEAARVDQLTVPTLAKGETWASIKDLTVDVAGLAARGMAFERLDQLALEHLYGVG

SEQ ID NO: 99 - DNA, 1164 bp, Thermus thermophilus
gtgtacgagcccaaaccggagcacaggtttacctttggcctttggactgtgggcaatgtgggccgtgatcccttcggggacgcggttcgggagaggctggacccggtttacgtggttcataagctggcggagcttggggcctacggggtaaaccttcacgacgaggacctgatcccgcggggcacgcctcctcaggagcgggaccagatcgtgaggcgcttcaagaaggctctcgatgaaaccggcctcaaggtccccatggtcaccgccaacctcttctccgaccctgctttcaaggacggggccttcacgagcccggacccttgggttcgggcctatgccttgcggaagagcctggagaccatggacctgggggcagagcttggggccgagatctacgtggtctggccgggccgggagggagctgaggtggaggccacgggcaaggcccggaaggtctgggactgggtgcgggaggcgctgaacttcatggccgcctacgccgaggaccagggatacgggtaccggtttgccctcgagcccaagcctaacgagccccggggggacatttacttcgccaccgtggggagcatgctcgcctttattcataccctggaccggcccgagcgcttcggcctgaaccccgagttcgcccacgagaccatggccgggcttaactttgtccacgccgtggcccaggctctcgacgccgggaagcttttccacattgacctcaacgaccaacggatgagccggtttgaccaggacctccgcttcggctcggagaacctcaaggcggcctttttcctggtggacctcctggaaagctccggctaccagggcccccgccactttgacgcccacgccctgcgtaccgaggacgaagaaggggtttgggccttcgcccgaggctgcatgcgtacctacctgatcttaaaggaaagggctgaagccttccgcgaggatcccgaggtcaaggagcttcttgccgcttactatcaagaagatcctgcggccttggcccttttgggcccctactcccgcgagaaggccgaagccctcaagcgggcggagcttcccctcgaggccaagcggcgccggggttatgccctggaacgcctggaccagctggcggtggagtacctcctgggggtgcgggggtga

SEQ ID NO: 100 - protein, 387 aa, Thermus thermophilus
MYEPKPEHRFTFGLWTVGNVGRDPFGDAVRERLDPVYVVHKLAELGAYGVNLHDEDLIPRGTPPQERDQIVRRFKKALDETGLKVPMVTANLFSDPAFKDGAFTSPDPWVRAYALRKSLETMDLGAELGAEIYVVWPGREGAEVEATGKARKVWDWVREALNFMAAYAEDQGYGYRFALEPKPNEPRGDIYFATVGSMLAFIHTLDRPERFGLNPEFAHETMAGLNFVHAVAQALDAGKLFHIDLNDQRMSRFDQDLRFGSENLKAAFFLVDLLESSGYQGPRHFDAHALRTEDEEGVWAFARGCMRTYLILKERAEAFREDPEVKELLAAYYQEDPAALALLGPYSREKAEALKRAELPLEAKRRRGYALERLDQLAVEYLLGVRG

SEQ ID NO: 101 - DNA, 1158 bp, Acidobacteria bacterium
atgtctgatgcttaccagccgcgaccggaacacaagttctcgttcggcctttggacgatcgcgaaccgcggccgcgatcctttcggcgatgcagtgcgccccactatccctccgaacgacattgtcgctttgctccgcgaggtaggcgcatggggggtcaatcttcacgataacgatcttgttccaattgacgcgacgccatccgagcgcgacaagatcgtccgcgattttcaggcggcctgcaggcagcacggcatcgtcgtgccgatggcgacggtcaacttgttcttcgatccaatcttcaaagatggagctttcaccgcaaacgacgccgatgtgcgtgcgtacgctcttcagaagacgatgcgcgctatggatctcggcgccgagttaggcgctaagctctttgtgctctggggtgggcgcgaaggaactgagactgatgcgtgccgccgtcccgaagaacccttcaagcggttgcgcgaagccatcgattatttgtgcgaatacaatctcgacaaaaagtatggtttcaaatttgcgttggaggccaagccaaacgaacctcgcggcgacatatacatgccgacgactggtgcctatctcggtttcatcccaacccttgcgcatccggagatggttggtgtaaatcctgaggtcgcgcacgagcacatggcgggattgaacgcgcttcacgcggttgcgcaagcatgggaagcgggcaaactcttccacatcgatctaaacgatcagaaccctgggcgctatgaccaggattttcgttttgcatctgcaaccccaaaatcaatgttctggttggtgaagttccttgaagactcggggtatcaagggccgcgccactttgacgcgcacgcttacaggacagaagacatcgccggcgtaaaggattttgcgcgcggatgcatgcgaagctacctgatcctgaaggaaaaggcgcagcgctggaatgccgacaaggagatccagcaaatcttctccgagatcaacccgcaaaccaccggcagctcgaaatattcacacgatggcgctctgtctcttctcaaccgcacctatgatcgcgcagccattgcgaagcgcggcctgcaatacgagcgcctcgatcagctgactatggaactgttgtggggaatacggtaa

SEQ ID NO: 102 - protein, 385 aa, Acidobacteria bacterium
MSDAYQPRPEHKFSFGLWTIANRGRDPFGDAVRPTIPPNDIVALLREVGAWGVNLHDNDLVPIDATPSERDKIVRDFQAACRQHGIVVPMATVNLFFDPIFKDGAFTANDADVRAYALQKTMRAMDLGAELGAKLFVLWGGREGTETDACRRPEEPFKRLREAIDYLCEYNLDKKYGFKFALEAKPNEPRGDIYMPTTGAYLGFIPTLAHPEMVGVNPEVAHEHMAGLNALHAVAQAWEAGKLFHIDLNDQNPGRYDQDFRFASATPKSMFWLVKFLEDSGYQGPRHFDAHAYRTEDIAGVKDFARGCMRSYLILKEKAQRWNADKEIQQIFSEINPQTTGSSKYSHDGALSLLNRTYDRAAIAKRGLQYERLDQLTMELLWGIR

SEQ ID NO: 103 - DNA, 1170 bp, Catenulispora acidiphila
atgaccgtcgcaccgtcccccgctgacaaattcaccttcggcctgtggaccgtgggctggcaggcccaggatccgttcggcgacccgacccgccccgcgctggacccggtggagaccgtccaccggctcgccgagctcggcgcctacggcgtcaccttccacgacgacgacctcatcccgttcggctccgccgacgacgagcgcgccaagcacatcgcccgcttccgcgaggccctggacgccaccggcctgaaggtgccgatggcgaccaccaacctgttcaagcacccggtcttcaaggacggcgcgttcaccagcaacgaccgcgacgtccgccgctacgcgctgcgcaaggtcatgcgcaacctggacctggccgccgaactcggcgcggacacctacgtcttctggggcggccgcgagggctcggagtccgacgccgccaaggacgtgcgcgccgcgctggaccgctaccgcgagggtctggacatgctggccgcctacgtcaccgaccgcggctacggcatccgcttcgccctggagcccaagcccaacgagccccgcggcgacatcctgctgccgaccatcggccacgccctgggcttcatcagcaccctggagcacgccgacatggtcgggctcaaccccgaggtcgggcacgagcagatggccggcctgaacttcgcccacggcatcgcgcaggcgctgtggcagggcaagctgttccacatcgacctcaacggccagcgcggcatcaagttcgaccaggacctggtcttcggccacggcgacctgctcaacgccttcttcctggtggacctgctggagaccggcggctacgaagggccgcggcacttcgactacaagccctcccgcaccgaggacatcaccggcgtctggcagtccgccgccgcgaacatgagcacctacctgctgctcaaggagcgcgccgcggccttccgcgccgaccccgaggtcgtcgaggcgcgcgccgcggcccgcgtggacgacctggggacgccgaccctcgccgccggcgagacctacgccgacctgctcgccgaccgcaccgccttcgaggacttcgaccccgaggaggccgccgagcgcggtctcggcgcggtccgcctgacccaactcgccgtcgagcacctgatgggcgcgcggtga

SEQ ID NO: 104 - protein, 389 aa, Catenulispora acidiphila
MTVAPSPADKFTFGLWTVGWQAQDPFGDPTRPALDPVETVHRLAELGAYGVTFHDDDLIPFGSADDERAKHIARFREALDATGLKVPMATTNLFKHPVFKDGAFTSNDRDVRRYALRKVMRNLDLAAELGADTYVFWGGREGSESDAAKDVRAALDRYREGLDMLAAYVTDRGYGIRFALEPKPNEPRGDILLPTIGHALGFISTLEHADMVGLNPEVGHEQMAGLNFAHGIAQALWQGKLFHIDLNGQRGIKFDQDLVFGHGDLLNAFFLVDLLETGGYEGPRHFDYKPSRTEDITGVWQSAAANMSTYLLLKERAAAFRADPEVVEARAAARVDDLGTPTLAAGETYADLLADRTAFEDFDPEEAAERGLGAVRLTQLAVEHLMGAR

SEQ ID NO: 105 - DNA, 1167 bp, Streptomyces corchorusii
atgagctaccagcccacccccgaggacaggttcacgttcggactctggaccgtcggctggcagggaagggacccgttcggcgacgccacccgccgcgccctcgacccggtcgagacggtgcagcgcctggcggaactcggtgcccacggagtgaccttccacgacgacgacctgatccccttcggttcgtcggacaccgagcgcgagtcgcacatcaagcggttccgccaggccctggacgccaccggcatgaccgtcccgatggccaccacgaacctcttcacgcaccccgtcttcaaggacggcgcgttcacggccaacgaccgcgacgtgcgccgctacgccctccgcaagacgatccgcaacatcgacctggcggccgagctgggcgcgaagacgtacgtcgcctggggtggccgcgagggcgccgagtccggcgccgccaaggacgtgcgttccgccctggaccgcatgaaggaggccttcgacctcctcggcgagtacgtcacctcgcagggctacgacctccgcttcgccatcgagcccaagccgaacgagccccgcggcgacatcctgctgcccaccgtcgggcacgcgctggccttcatcgagcgcctggagcggcccgagctctacggcgtcaaccccgaggtcggccacgagcagatggccggcctgaacttcccgcacggcatcgcgcaggccctgtgggccgggaagctgttccacatcgacctcaacggccagtccggcatcaagtacgaccaggacctgcggttcggcgcgggcgacctgcggtccgccttctggctggtcgacctcctggagagcgccggttacgaaggaccgcgccacttcgacttcaagccgccgcggaccgaggacctcgacggcgtgtgggcctcggcggcgggctgcatgcgcaactacctcatcctgaaggagcgcgcggcagccttccgcgccgaccccgaggtgcaggcggcgctgcgcgcctcgcgcctggaccagctggcccagccgaccgcggccgacggcctggaggacctgctcgccgaccgcgcggccttcgaggacttcgacgtggaggccgccgccgcgcgcggcatggccttcgaacgcctcgaccagctggcgatggaccacctgctgggcgcgcggggctga

SEQ ID NO: 106 - protein, 388 aa, Streptomyces corchorusii
MSYQPTPEDRFTFGLWTVGWQGRDPFGDATRRALDPVETVQRLAELGAHGVTFHDDDLIPFGSSDTERESHIKRFRQALDATGMTVPMATTNLFTHPVFKDGAFTANDRDVRRYALRKTIRNIDLAAELGAKTYVAWGGREGAESGAAKDVRSALDRMKEAFDLLGEYVTSQGYDLRFAIEPKPNEPRGDILLPTVGHALAFIERLERPELYGVNPEVGHEQMAGLNFPHGIAQALWAGKLFHIDLNGQSGIKYDQDLRFGAGDLRSAFWLVDLLESAGYEGPRHFDFKPPRTEDLDGVWASAAGCMRNYLILKERAAAFRADPEVQAALRASRLDQLAQPTAADGLEDLLADRAAFEDFDVEAAAARGMAFERLDQLAMDHLLGARG

SEQ ID NO: 107 - DNA, 1167 bp, Streptomyces thermocyaneoviolaceus
atgaactaccagcccacccccgaggacaggttcaccttcggcctgtggaccgtcggctggcaggggcgggaccccttcggcgacgccacgcgtcccgccctcgacccggtcgaggcggtgcagcggctggccgaactgggcgcctacggagtgaccttccacgacgacgacctgatccccttcgggtcgtccgacgccgagcgcgaggcgcacgtcaagcggttccgtcaggctctcgacgcgaccggtatgaccgtcccgatggccaccaccaacctcttcacccaccccgtcttcaaggacggcgcgttcaccgccaacgaccgcgacgtgcgccgttacgccctgcgcaagaccatccggaacatcgacctcgcggtcgagctgggcgccaaggtctacgtcgcctggggcggccgcgagggcgcggagtccggtgccgccaaggacgtgcgtgcggccctggaccgcatgaaggaggccttcgacctgctcggcgagtacgtcacctcgcagggctacgacatccggttcgccatcgagcccaagcccaacgagccgcgcggcgacatcctgctgcccaccatcggccacgcgctcgccttcatcgagcgcctggagcgccccgagctgtacggcgtcaaccccgaggtgggccacgagcagatggccggcctgaacttcccgcacggcatcgcgcaggccctgtgggcgggcaagctcttccacatcgacctcaacggtcagtccggcatcaagtacgaccaggacctgcgcttcggcgccggtgacctgcgcgccgccttctggctggtcgacctgctggagagcgccggctgggagggtccgcgccacttcgacttcaagcccccgcggaccgaggacatcgacggcgtgtgggcctccgcggccggctgcatgcgcaactacctcatcctgaaggagcgcgccgccgccttccgggccgacccggaggtccaggaggccctgcgtgctgcccggctcgaccagctcgccgagcccaccgcggccgacggcctgcaggccctgctggccgaccgcaccgcgtacgaggacttcgacgtggacgcggccgccgcgcgcggcatggccttcgagcgcctcgaccagctcgccatggaccacctgctgggcgcccggggctga

SEQ ID NO: 108 - protein, 388 aa, Streptomyces thermocyaneoviolaceus
MNYQPTPEDRFTFGLWTVGWQGRDPFGDATRPALDPVEAVQRLAELGAYGVTFHDDDLIPFGSSDAEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 109 - DNA, 1191 bp, marine actinobacterium
atgcctacacaacccacacccgccgacaagttctccttcgggctctggaccatcggctacaacggagccgaccccttcggaggcccaacccgcgcccctctcgatgtcgttcacggcgttgaaaagctcgccgagctcggtgcctacggcctcaccttccacgacgatgatctcttcgcctttggatctacggatgccgaacgccagaagcaaatcgaccgcctcaagcaagtactcagcgacaccggtctcatcgtgccaatggtcaccactaacctcttcagcgctcccgttttcaaagacggcggcttcacttccaacgaccgcggcgttcgtcgtttcgctatgcgcaaagcaatgcgtcaactggaactcggtgtagagctcggcgccaagacgttcgtcatgtggggcggccgcgagggcgcagagtacgactccgctaaagacgtgcgctccgccctcgaacgctaccgcgaagccctcaacctgtttggtgactacgtcactgaaaaggactacgacatccgcttcgctattgagcccaagcccaacgagccccgcggcgacatcctgctacccaccgtcggtcacgccattgcattcattgagaccctcgaacgccccgaactgttcggcgtgaaccccgaagtcggtcacgagcagatggctggcctgaactttacatcgggcatcgcccaagctctctaccaagacaagctcttccacatcgacctcaacggtcagcgtggaatcaagtacgaccaagacctcgttttcgggcacggcgacctccacaacgcgttctcgctcgtcgatctgctcgaaaatggtggccccaacggcggccagagctacaccggtcctcgtcacttcgattacaagcccagccgcaccgaagacgagaccggcgtctgggattccgctgccgccaacatgcgcacctacctgctactcaaggagcgtgcagcagccttccgcgccgaccccgatgtgcaagaagccctgcaagctgcgcgcgtcttcgaactggccgagaacaccctcggcgagaatgaaagctatgacgacctgttggcagaccgcgcctcgtacgaagacttcgaccacggggcctatttcaacggcaagggcttcggctttgttcgcctgcagcagctcgcaaccgagcacctcatgggcgcccgctaa

SEQ ID NO: 110 - protein, 396 aa, marine actinobacterium
MPTQPTPADKFSFGLWTIGYNGADPFGGPTRAPLDVVHGVEKLAELGAYGLTFHDDDLFAFGSTDAERQKQIDRLKQVLSDTGLIVPMVTTNLFSAPVFKDGGFTSNDRGVRRFAMRKAMRQLELGVELGAKTFVMWGGREGAEYDSAKDVRSALERYREALNLFGDYVTEKDYDIRFAIEPKPNEPRGDILLPTVGHAIAFIETLERPELFGVNPEVGHEQMAGLNFTSGIAQALYQDKLFHIDLNGQRGIKYDQDLVFGHGDLHNAFSLVDLLENGGPNGGQSYTGPRHFDYKPSRTEDETGVWDSAAANMRTYLLLKERAAAFRADPDVQEALQAARVFELAENTLGENESYDDLLADRASYEDFDHGAYFNGKGFGFVRLQQLATEHLMGAR

SEQ ID NO: 111 - DNA, 1251 bp, Micromonospora sp.
atggcaccccgtcccacccccgccgacaagttctccttcggcctctggacggtgggctggcaggcccgtgacccgttcggcgacgccacccgccccgagctggacgccgtcgaggcggtgcacaagctcgccgagttgggcgcgtacgggatcaccttccacgacgacgacctgatcccgttcggcgcggacgccgccgcccgcgacgcccagctcgcccggttccgcaaggccctcgacgagaccggcctggtcgtcccgatggtcaccaccaacctcttcacccacccggtgttcaaggacggcggcttcaccagcaacgaccgcgacgtgcgccggtacgcgctgcgcaaggtgctgcgcaacgtcgacctggccgccgagctgggcgcgaagacgttcgtcatgtggggcggccgggagggcgccgagtacgacgtggccaaggacatccgctcggcgctggaccgctaccgcgaggccgtcgacctgctctgccagtacgtcgtcgactccggctacgacctgcgcttcgccatcgagccgaagccgaacgagccgcgcggcgacatcctgctgcccaccgtcggtcacgcgttggcgttcatctccaccctggcccgcccggagatggtgggcctcaaccccgaggtcggccacgagcagatggccgggctcaacttcacccacggcatcgcccaggcgctctggcagggcaagctgttccacatcgacctcaacggccagcgcggcatcaagtacgaccaggacctggtcttcggccacggcgacctgatgaacgcgttcgccctggtggacctgctggagaacggcggccccgacggcggccccgcctacgacggcccccggcacttcgactacaagccgtcgcgcaccgaggacttcaccggcgtgtgggcctcggccgaggcgaacatgcgcacctacctgctgctcaaggagcgggccgcagcgttccgggccgacccggaggtggccgaggccctcgcggcgagccgcgtcggcgacctggccgtgccgaccgtcgcgcccggtgagagctacgccgacctgctcgccgaccgctccgccttcgaggagtacgacgtcgatgccgcggccgcgcgcggcttccacttcgtccggctcaaccagcttgccgtcgagcacgtgctcgggcgcccgctgaggccgccgccatgcctctggtcgccgggttcgactcgtccacccagtcgtgcaagctggtga

SEQ ID NO: 112 - protein, 416 aa, Micromonospora sp.
MAPRPTPADKFSFGLWTVGWQARDPFGDATRPELDAVEAVHKLAELGAYGITFHDDDLIPFGADAAARDAQLARFRKALDETGLVVPMVTTNLFTHPVFKDGGFTSNDRDVRRYALRKVLRNVDLAAELGAKTFVMWGGREGAEYDVAKDIRSALDRYREAVDLLCQYVVDSGYDLRFAIEPKPNEPRGDILLPTVGHALAFISTLARPEMVGLNPEVGHEQMAGLNFTHGIAQALWQGKLFHIDLNGQRGIKYDQDLVFGHGDLMNAFALVDLLENGGPDGGPAYDGPRHFDYKPSRTEDFTGVWASAEANMRTYLLLKERAAAFRADPEVAEALAASRVGDLAVPTVAPGESYADLLADRSAFEEYDVDAAAARGFHFVRLNQLAVEHVLGRPLRPPPCLWSPGSTRPPSRASW

SEQ ID NO: 113 - DNA, 1158 bp, Thermobifida fusca
atgagcaactaccagcccacacccgaggaccggttcagcttcggactgtggactgtgggatggcgcggccacaacaccttcggcaaggccgtacgcccgcaactcgaccccgtcgacgtcgtctggaaactccgcgaactcggcgcctacggcatcaccttccacgacgacgacctcctcccgccggacagcacccccgcggaacgcgacgccatcatcaaacgcttcacccgggcgctcgaagagagcggcatgaccgtccccatggtcactaccgacctcttcagccaccccgtcttccgcgacggcggcttcacctccaacagccgcgacgtgcgccgctacgccctgcgcaaggtcatgcgcaacatcgaccgcgccgcggaactcggcgcccgcacctacgtgtgctggggcggcatggacggcgccgaatacgaacccgccaagaacatctccgccgcgctcgaccgcctgcgcgaagccttcaacatcctgtgcgaatacgtccgcagcaagggctacaacctgcggttcgccctcgaacccaaacccaacgagccccgcggcgacatcctcctgcccaccatcggccacgccatcgccttcatcaacgagctcgaccaccccgaaatggtcggcctcaaccccgaagtcggccacgaacagatggccggactcaacttcacccacggcatcgcccaagccctctggcacggcaaactgttccacatcgacctcaacggccagcgcggcatcaaatacgaccaggacctgcgcttcggcgccggcgacgtgcgcgacgcgttcttcctcgtcaacctgctggaaagcagtggctacgacggaccgcgccacttcgacttcaagaccccgcgcaccgaagacgtcgacggcgtgtgggaagcggcacgcaactgcatgcgcaactacctcatcttcaaggagaaggctgaagcgttccgcgccgaccccgaagtccgcgaagccatggaagccgcccgggtcttcgaactggagcagtccaccctcgccgaaggggagaccctggacgacctgctcgccgaagacatcaacctggacgaagtggcccagcgcggctaccacttcgaacgcctcgaccagctcgccctcgactacctcctgggcgtgcgctaa

SEQ ID NO: 114 - protein, 385 aa, Thermobifida fusca
MSNYQPTPEDRFSFGLWTVGWRGHNTFGKAVRPQLDPVDVVWKLRELGAYGITFHDDDLLPPDSTPAERDAIIKRFTRALEESGMTVPMVTTDLFSHPVFRDGGFTSNSRDVRRYALRKVMRNIDRAAELGARTYVCWGGMDGAEYEPAKNISAALDRLREAFNILCEYVRSKGYNLRFALEPKPNEPRGDILLPTIGHAIAFINELDHPEMVGLNPEVGHEQMAGLNFTHGIAQALWHGKLFHIDLNGQRGIKYDQDLRFGAGDVRDAFFLVNLLESSGYDGPRHFDFKTPRTEDVDGVWEAARNCMRNYLIFKEKAEAFRADPEVREAMEAARVFELEQSTLAEGETLDDLLAEDINLDEVAQRGYHFERLDQLALDYLLGVR

SEQ ID NO: 115 - DNA, 1149 bp, Herpetosiphon aurantiacus
atgacacagcataaatttagctttggattatggacagttggcaatgttgggcgtgacccatttggtgaaccagtgcgcaaaaccctctcgccagttgagattgtgcatttgttggctgaagttggagcatggggcgtaaattttcacgataacgatttagtgccgattgatgctagtgccagccaaaaagcccaaattattgccgatttcaaacaagcactcaaggataccggcttggttgtgccgatggcaaccaccaatttattcggtcacccagcctttaaagatggcgcatttaccagcaacgatccggctgtgcgggcttatgccttgcaaaaaaccatggcagccatggatttgggcgctgaatttggcgcgaaaacctatgtgttttggggtggccgtgaaggcagcgaaaccgatgcctcgaaaaatctgctcgaaggcttgaagtggttccgcgaagcgctcaacttcttgtgcgactatagcaatgcccaaggctatggctatcgttttgccttggaagccaagcccaacgaaccacgcggcgatatcttcttgcctaccaccggagccatgttgggctttattcagaccctcgatcagcccgagatggtgggggtaaatcccgaagttgcccatgaaaccatggcaggcttgaattttacccatgccgtggcccaagcgcttgatgctggcaaactgttccatatcgacctcaacgatcaaaatagtggtcgctacgaccaagattatcgctttggagcacaaaactacaaacaaagctttttcttggtgaaattgctgcaagatgctggctacgatggcccattgcacttcgatgctcacgcttaccgcagcgaagatcttgagggagttaaagattttgcccgtggttgtatgcgtacctaccaaattttggccgaaaaagttcagcgcttcaatgctgatgctgaaattcaagccttgttagctcaaatcaacgccccaaatgccgatgttgagcaattccgtggtggctacacgccagaacgtgccgctgcgctcaaagcctatcaatttgatcgtcaagcacttggcgaacgcggcctcggctacgaaaagcttgatcaactaaccttcgagttgttgatgggagccagatag

SEQ ID NO: 116 - protein, 382 aa, Herpetosiphon aurantiacus
MTQHKFSFGLWTVGNVGRDPFGEPVRKTLSPVEIVHLLAEVGAWGVNFHDNDLVPIDASASQKAQIIADFKQALKDTGLVVPMATTNLFGHPAFKDGAFTSNDPAVRAYALQKTMAAMDLGAEFGAKTYVFWGGREGSETDASKNLLEGLKWFREALNFLCDYSNAQGYGYRFALEAKPNEPRGDIFLPTTGAMLGFIQTLDQPEMVGVNPEVAHETMAGLNFTHAVAQALDAGKLFHIDLNDQNSGRYDQDYRFGAQNYKQSFFLVKLLQDAGYDGPLHFDAHAYRSEDLEGVKDFARGCMRTYQILAEKVQRFNADAEIQALLAQINAPNADVEQFRGGYTPERAAALKAYQFDRQALGERGLGYEKLDQLTFELLMGAR

SEQ ID NO: 117 - DNA, 1167 bp, Streptomyces griseus
atgacggaacgcttcacccccactcccgaggacaagttcagcttcggcctgtggaccgtgggctggcagggccgggatcccttcggggacgccacccgcgcggccatcgaccccgtggagtcggtgcggcggctcgctgagctgggagcctggggggtgaccttccacgacgacgacctgatccccttcggggcgccggaggccgagcgcgagaggatcgtcaagcgcttccgcaaggcggtcgacgacagcggtctcgtcgtgcccatggtgacgacgaacctcttcacccaccccgtcttcaaggacggcggattcaccgccaacgaccggggggtgcgccggtacgcactccgcaagaccctgcgcaacatcgacctcgccgtcgagctgggggcgacgaccttcgtggcgtggggcggccgcgagggggccgagtccggcggggcgaaggacgtccgcctcgccctccaccggatgaaggaggccttcgacctgctgggcgagtacgtcgtcgagcagggctacgacctccgtttcgccgtcgagcccaagccgaacgagccgcgcggcgacatcctgctgccgaccatcggccacgccctggccttcatcgagcgcctggagcgtcccgagctggtcggcgtcaacccggagaccggccacgagcagatggccgggctcaacttcccgcacggcatcgcccaggccatgtgggcggacaagctcttccacatcgacctcaacggccagtccggcatcaagtacgaccaggacctgcgcttcggcgcgggcgatctgcggcaggcgttctggctcgtcgacctgttggagagcggctacgaaggcccccgccacttcgacttcaagcccccgcgcaccgaggaccacgacggtgtctgggcctcggcggcgggctgcatgcgcaactacctcatcctcaaggagcgcgccgcagccttccgcgccgaccccgaggtgcgggctgcccttcgcgcgtcccgcctggacgaactggcccgccccaccgcaggcgacgggctggcgggcctgctcgccgaccgcaacgcctacgaggacttcgacgtggacgccgccgcggaacgcggcatggccttcgaggcgctggaccagctcgccatggaccacctgctcgccgtgcgctga

SEQ ID NO: 118 - protein, 388 aa, Streptomyces griseus
MTERFTPTPEDKFSFGLWTVGWQGRDPFGDATRAAIDPVESVRRLAELGAWGVTFHDDDLIPFGAPEAERERIVKRFRKAVDDSGLVVPMVTTNLFTHPVFKDGGFTANDRGVRRYALRKTLRNIDLAVELGATTFVAWGGREGAESGGAKDVRLALHRMKEAFDLLGEYVVEQGYDLRFAVEPKPNEPRGDILLPTIGHALAFIERLERPELVGVNPETGHEQMAGLNFPHGIAQAMWADKLFHIDLNGQSGIKYDQDLRFGAGDLRQAFWLVDLLESGYEGPRHFDFKPPRTEDHDGVWASAAGCMRNYLILKERAAAFRADPEVRAALRASRLDELARPTAGDGLAGLLADRNAYEDFDVDAAAERGMAFEALDQLAMDHLLAVR

SEQ ID NO: 119 - DNA, 1224 bp, Mycobacterium vanbaalenii
atgaccgtgctggagtccagccgccccgttcccgacgccctgagcccgagacgcgaggacaagttctcgttcggcctctggacggtcggatggcccggcgtcgacccgttcggcgtcgccacccgtccggcgctcgacgccatcgaggccgtggatcggctggccgcactgggcgcctacggcttgacgttccacgacgacgacctcttcgcgttcggcagctccgatggcgagcgccggcgggccatcgatcggctgacctccgcgttgagcgccaacggtctggtcgttccgatggtgaccaccaacctgttcactcaaccggtcttcaaggacggcggcttcaccagcaacgaccgcgcggtgcgtcgcttcgcgctgcgcaaggtgctgcgcaacctcgatctggccgccgaactcggtgcccagaccttcgtgatgtggggcggccgtgagggcggcgaatacgactcggccaaagacgtgcaggcggcgctggaacgctatcgcgaggcgctggatgtgctgtgccagtacgtgatcgaccagggcagcggaatccgcttcgcgatcgagccgaaacccaacgaaccccggggcgacatcctgctgccgacggtcggtcacgctctcgcgttcatcgagacccttgcccatccggagatggtcggggtcaaccccgagaccgggcacgagcagatgtccgggttgaacttcacgcacggcatcgcccaagccctgtacagcggcaagcttttccacatcgacctgaacgggcagcgcggtatcaagttcgaccaggacctggtgttcgggcacggagacctggtcaacgccttctcgctggtggatctgctcgagcacggtggacccgacggtggtccggcctatgacggccctcggcatttcgactacaagccgagtcgcaccgaggacgccgaaggggtatgggcgtcggccgcggccaacatgcggatgtatctgctgctgcggcagcgcgccgcggccttccgcgccgatcccgacgtgcgtgaggcgatggtcgccgccaaggtggccgaactgcgcaagccgacgctggcggccggggagacctacgccgacctgctgaacgaccggtccgcctacgaggaattcgacaccggcgcctatttcggtggaaagggttgcggcttcgtggctctgcaccagttggccgtcgagcacctgatgggggcgcggtga

SEQ ID NO: 120 - protein, 407 aa, Mycobacterium vanbaalenii
MTVLESSRPVPDALSPRREDKFSFGLWTVGWPGVDPFGVATRPALDAIEAVDRLAALGAYGLTFHDDDLFAFGSSDGERRRAIDRLTSALSANGLVVPMVTTNLFTQPVFKDGGFTSNDRAVRRFALRKVLRNLDLAAELGAQTFVMWGGREGGEYDSAKDVQAALERYREALDVLCQYVIDQGSGIRFAIEPKPNEPRGDILLPTVGHALAFIETLAHPEMVGVNPETGHEQMSGLNFTHGIAQALYSGKLFHIDLNGQRGIKFDQDLVFGHGDLVNAFSLVDLLEHGGPDGGPAYDGPRHFDYKPSRTEDAEGVWASAAANMRMYLLLRQRAAAFRADPDVREAMVAAKVAELRKPTLAAGETYADLLNDRSAYEEFDTGAYFGGKGCGFVALHQLAVEHLMGAR

SEQ ID NO: 121 - DNA, 1167 bp, Streptomyces diastaticus
atgagctaccagcccacccccgaggacaagttcacgttcggcctgtggaccgtcggctggcagggacgggaccccttcggcgacgccacccgcggcgccctcgacccggccgagtccgtccgccgcctcgccgagctcggcgcccacggcgtgacgttccacgacgacgacctcatccccttcggcgcgacggacagcgagcgcgccgagcacatcaagcggttccgccaggggctggacgagaccggcatgaaggtcccgatggcgaccaccaacctgttcacccacccggtgtttaaggacggcggcttcaccgcgaacgaccgtgacgtgcgccgttacgccgtgcgcaagaccatccgcaacatcgacctcgcggtcgagctcggcgcgcagacctacgtcgcctggggcggccgcgagggcgccgagtccggcgccgccaaggacgtccgggtcgccctcgaccgcatgaaggaggctttcgacctcctcggcgagtacgtcacctcccagggctacgacactccgttcgccatcgagcccaagccgaacgagccccgcggcgacatcctcctgccgacgatcggccacgccctcgccttcatcgacggcctcgagcgcccggagctgtacggcgtcaacccggaggtcggccacgagcagatggccgggctcaacttcccgcacggcatcgcccaggccctgtgggcgggcaagctgttccacatcgacctcaacggccagtccggcatcaagtacgaccaggacctccgcttcgggccgggcgacctggccgccgcgttctggctggtggacctgctggagtcggccggctacgagggcccgcgccacttcgacttcaagccgccgcggaccgaggacttcgacggcgtctgggcctccgcggccggctgcatgcgcaactacctgatcctcaaggagcgcgcggccgccttccgtgcggacccggaggtgcaggaggcgctgcgcgcggcccggctggacgagctcgcccagccgacggcgggcgacggcctccaggccctgctgcccgaccgctcggcgttcgaggacttcgacccggacgcggcggcggcccgtggcatggccttcgagcggctggaccagctggcgatggaccacctgctgggcgcgcggggctag

SEQ ID NO: 122 - protein, 388 aa, Streptomyces diastaticus
MSYQPTPEDKFTFGLWTVGWQGRDPFGDATRGALDPAESVRRLAELGAHGVTFHDDDLIPFGATDSERAEHIKRFRQGLDETGMKVPMATTNLFTHPVFKDGGFTANDRDVRRYAVRKTIRNIDLAVELGAQTYVAWGGREGAESGAAKDVRVALDRMKEAFDLLGEYVTSQGYDTPFAIEPKPNEPRGDILLPTIGHALAFIDGLERPELYGVNPEVGHEQMAGLNFPHGIAQALWAGKLFHIDLNGQSGIKYDQDLRFGPGDLAAAFWLVDLLESAGYEGPRHFDFKPPRTEDFDGVWASAAGCMRNYLILKERAAAFRADPEVQEALRAARLDELAQPTAGDGLQALLPDRSAFEDFDPDAAAARGMAFERLDQLAMDHLLGARG

SEQ ID NO: 123 - DNA, 1212 bp, Deinococcus geothermalis [sequence omitted]

SEQ ID NO: 124 - protein, 403 aa, Deinococcus geothermalis
MPDYTPTPADKFTFGLWTVGQTGRDPFGEATRPGFSAPYIVQKLAELGAYGVNLHDNDLVPIDATPQQRDRIVAEFKQALSDHGLVVPMATTNLFTDPVFKDGAFTSADARVRAYALQKTMQSMDLGHELGAQTYVFWGGREGTEVDASSKLLDALAWFRDSLNFLAEYSQSQGYGYRFALEPKPNEPRGDIFFPTAGSMLGFIATLDQPDLFGVNPEFAHDTMAGLNFTHAVAQVIDAGKLFHIDLNDQKMGRFDQDLRFGAENLKTAFFLVKLLEDSGYDGPRHFDAHALRTEDEEGVWAFARGCMRTYLILKEKAQQFDEDPEIQAALAAYRVDDEELSRLTAKFSPENAKALKARTFDRELLGRRGPGLEQLDQLTVELLLGLRGHTSTTTHPEIEVTR

SEQ ID NO: 125 - DNA, 1188 bp, Arthrobacter sp.
atgactcttcagcccaccccagcagaccgcttcaccttcggcctttggaccgtcggctggaccggggcggatcctttcggggtcgccacccgccctgccctggaccccgtcgaggccgtccacaagctcagcgaactgggcgcttacggcatcaccttccatgacaatgacctggtcccgttcgacgcaacggcttccgagcgcgagctgatcctgaagaacttcaaggccgccctcgccgagacgggcctcaagacccccatggtcaccaccaacctgttcagccatcctgtcttcaaggacggcggctttacctccaatgaccggtccgtccgccggttcgcgctcagcaaggtccttcagaacatcgaccttgcagccgagctgggtgcggagaccttcgtcatgtggggcgggcgcgaaggcagcgagtatgacggttccaaggacctctctgccgcgctggaccggatgaaggaaggcgtggacacggccgcggcttacatcaaggacaaggggtacggccttcggatcgccctggaaccgaagcccaacgagccccgcggcgacatcttcctgcccaccgtcggccacggactggccttcatcgcgcagctggaacacggcgacatcgtgggcctcaacccggaaaccgggcacgagcagatggccggactgaacttcacccatggcatcgcccaggcgctgtgggccggcaagctcttccacatcgacctcaacggccagcgcggcatcaagtacgaccaggacctcgtgttcgggcacggcgacctcaccagcgcattcttcaccgtggacctgctcgaaaacggcttccccaacggcggtccgaagtatgacggcccgcgtcacttcgactacaagccctcacgcaccgacggatacgacggcgtctgggaatccgcgaaatccaacatgtccatgtacctcctcctgaaggagcgcgccctggccttccgcgccgaccccgatgtccaggaagccctgaagacctccggtgtcttcgaactcggcgagcccacccttgccgccggagagaccacggcggatttgctggctgacgcttccgcgttcgcggagttcgacgccgatgccgccgcccagcggtcattcgccttcgtccgcctcaaccagctggccatcgagcacctgctcggcgcccgctag

SEQ ID NO: 126 - protein, 395 aa, Arthrobacter sp.
MTLQPTPADRFTFGLWTVGWTGADPFGVATRPALDPVEAVHKLSELGAYGITFHDNDLVPFDATASERELILKNFKAALAETGLKTPMVTTNLFSHPVFKDGGFTSNDRSVRRFALSKVLQNIDLAAELGAETFVMWGGREGSEYDGSKDLSAALDRMKEGVDTAAAYIKDKGYGLRIALEPKPNEPRGDIFLPTVGHGLAFIAQLEHGDIVGLNPETGHEQMAGLNFTHGIAQALWAGKLFHIDLNGQRGIKYDQDLVFGHGDLTSAFFTVDLLENGFPNGGPKYDGPRHFDYKPSRTDGYDGVWESAKSNMSMYLLLKERALAFRADPDVQEALKTSGVFELGEPTLAAGETTADLLADASAFAEFDADAAAQRSFAFVRLNQLAIEHLLGAR

SEQ ID NO: 127 - DNA, 1167 bp, Streptomyces rubiginosus
atgaactaccagcccacccccgaggacaggttcaccttcggactgtggaccgtcggctggcagggacgggaccccttcggtgacgccacgcggcgcgccctcgacccggtcgagtcggtgcggcggctggccgagctgggcgcccacggcgtcacgttccacgacgacgacctcatccccttcggctccagcgacagcgagcgcgaggagcacgtcaagcggttccggcaggcgctggacgacaccggcatgaaggtgccgatggccaccaccaacctgttcacccacccggtgttcaaggacggcggcttcaccgccaacgaccgcgacgtgcgccgctacgccctgcgcaagaccatccgcaacatcgacctcgcggtcgagctcggcgccgagacctatgtggcctggggcggccgcgagggtgccgagtcgggtggcgccaaggacgtgcgggacgccctcgaccgcatgaaggaggccttcgacctgctcggcgagtacgtcacctcccagggctacgacatccgcttcgccatcgagcccaagccgaacgagccgcgcggcgacatcctgctccccaccgtcggccacgccctggcgttcatcgagcgcctggagcgaccggagctgtacggcgtgaaccccgaggtcggccacgagcagatggccgggctgaacttcccgcacggcatcgcgcaggcgctgtgggcgggcaagctgttccacatcgacctcaacggccagaacggcatcaagtacgaccaggacctccgcttcggcgcgggcgacctgcgggccgcgttctggctggtggacctgctggagtcggccggctacagcggcccgcggcacttcgacttcaagccgccgcggaccgaggacttcgacggggtgtgggcctcggcggccggctgcatgcgcaactacctgatcctcaaggagcgtgcggcggccttccgcgccgaccccgaggtgcaggaggcgctgcgcgcgtcccgtctggacgagctggcccggcccacggcggccgacggtctgcaggccctgctcgacgaccggtccgccttcgaggagttcgacgtcgacgcggcggcggcccgtgggatggccttcgagcgcctggaccagctggcgatggaccacctgctgggcgcccggggctga

SEQ ID NO: 128 - protein, 388 aa, Streptomyces rubiginosus
MNYQPTPEDRFTFGLWTVGWQGRDPFGDATRRALDPVESVRRLAELGAHGVTFHDDDLIPFGSSDSEREEHVKRFRQALDDTGMKVPMATTNLFTHPVFKDGGFTANDRDVRRYALRKTIRNIDLAVELGAETYVAWGGREGAESGGAKDVRDALDRMKEAFDLLGEYVTSQGYDIRFAIEPKPNEPRGDILLPTVGHALAFIERLERPELYGVNPEVGHEQMAGLNFPHGIAQALWAGKLFHIDLNGQNGIKYDQDLRFGAGDLRAAFWLVDLLESAGYSGPRHFDFKPPRTEDFDGVWASAAGCMRNYLILKERAAAFRADPEVQEALRASRLDELARPTAADGLQALLDDRSAFEEFDVDAAAARGMAFERLDQLAMDHLLGARG

SEQ ID NO: 129 - DNA, 1164 bp, Streptomyces murinus
atgagcttccagcccacccccgaggacaggttcaccttcggtctgtggaccgtcggctggcagggaagggacccgttcggcgacgccacccgccccgccctcgacccggtcgagacggtgcagcgcctggccgagctgggcgcctacggagtgaccttccacgacgacgacctgatccccttcgggtcctccgacaccgagcgcgagtcgcacatcaagcgcttccgccaggccctggacgccaccggcatgacggtgcccatggccaccaccaacctcttcacccaccccgtcttcaaggacggcggcttcaccgccaacgaccgcgacgtacgccggtacgcgctgcgcaagacgatcggcaacatcgacctggcggccgaactgggtgccaagacgtatgtcgcctggggcggccgtgagggcgccgagtccggtggcgccaaggacgtgcgcgacgccctcgaccgcatgaaggaggcgttcgacctcctcggcgagtacgtcaccgcccagggctacgacctccgcttcgccatcgagcccaagcccaacgagccccgcggcgacatcctgctgcccaccgtcggccacgccctggccttcatcgagcgcctggagcgcccggagctgtacggcgtcaacccggaggtcggccacgagcagatggccggcctgaacttcccgcacggcatcgcgcaggccctgtgggcgggcaagctcttccacatcgacctcaacggccagtccggcatcaagtacgaccaggacctgcggttcggcgccggcgacctgcgggcggcgttctggctggtcgacctcctggagaccgccggttacgagggcccgcggcacttcgacttcaagccgccgcggaccgaggacttcgacggcgtgtgggcctcggccgcgggctgcatgcgcaactacctgatcctcaaggaccgtgcggccgccttccgtgccgacccggaggtgcaggaggcgctgcgtgccgcgcgtctggaccagctggcccagccgaccgcggccgacggccttgacgccctgctcgccgaccgcgcggcgttcgaggacttcgacgtcgatgccgccgccgcgcgcggtatggcgttcgagcacctcgaccagctggcgatggaccacctgctgggcgcgcgcggc

SEQ ID NO: 130 - protein, 388 aa, Streptomyces murinus
MSFQPTPEDRFTFGLWTVGWQGRDPFGDATRPALDPVETVQRLAELGAYGVTFHDDDLIPFGSSDTERESHIKRFRQALDATGMTVPMATTNLFTHPVFKDGGFTANDRDVRRYALRKTIGNIDLAAELGAKTYVAWGGREGAESGGAKDVRDALDRMKEAFDLLGEYVTAQGYDLRFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLETAGYEGPRHFDFKPPRTEDFDGVWASAAGCMRNYLILKDRAAAFRADPEVQEALRAARLDQLAQPTAADGLDALLADRAAFEDFDVDAAAARGMAFEHLDQLAMDHLLGARG

SEQ ID NO: 131 - protein, 387 aa, Thermus caldophilus
MYEPKPEHRFTFGLWTVGNVGRDPFGDAVRERLDPVYVGHKLAELGVHGVNLHDEDLIPRGTPPQERDQIVRRFKRALDETGLKVPMVTGNLFSDPGFKDGGFTSRDPWVRAYAFRKSLETMDLGAELGAEIYVVWPGREGAEVEATGKARKVWDWVREPLNFMAAYAEDQGYGYRFALEPKPNEPRGDIYFATVGSMLALIHTLERPERFGLNPEFAHETMAGLNFVHAVAQALDAGKLLHIDLNGQRMNRFDQDLRFGSENLKAAFLLVDLLESSGYQGPRHFDAHALRTEDEEGVWAFARGCMRTYLILKERAEAFREDPEVKELLAAYYQEDPAALPLMDPYSHEKAEALKRAELPLEAKRHRGYALERLDQLAVEYLLGVRG

SEQ ID NO: 132 - protein, 387 aa, Thermus caldophilus
MYEPKPEHRFTFGLWTVGNVGRDPFGDAVRERLDPVYVGHKLAELGVHGVNLHDEDLIPRGTPPAERDQIVRRFKRALDETGLKVPMVTGNLFSDPGFKDGGFTSRDPWVRAYAFRKSLETMDLGAELGAEIYVVWPGREGAEVEATGKARKVWDWVREPLNFMAAYAEDQGYGYRFALEPKPNEPRGDIYFATVGSMLALIHTLERPERFGLNPEFAHETMAGLNFVHAVAQALDAGKLLHIDLNGQRMNRFDQDLRFGSENLKAAFLLVDLLESSGYQGPRHFDAHALRTEDEEGVWAFARGCMRTYLILKERAEAFREDPEVKELLAAYYQEDPAALPLMDPYSHEKAEALKRAELPLEAKRHRGYALERLDQLAVEYLLGVRG

SEQ ID NO: 133 - protein, 393 aa, Arthrobacter sp.
VQPTPADHFTFGLWTVGWTGADPFGVATRANLDPVEAVHKLAELGAYGITFHDNDLIPFDATAAEREKILGDFNQALADTGLKVPMVTTNLFSHPVFKDGGFTSNDRSIRRFALAKVLHNIDLAAEMGAETFVMWGGREGSEYDGSKDLAAALDRMREGVDTAAGYIKDKGYNLRIALEPKPNEPRGDIFLPTVGHGLAFIEQLEHGDIVGLNPETGHEQMAGLNFTHGIAQALWAEKLFHIDLNGQRGIKYDQDLVFGHGDLTSAFFTVDLLENGFPNGGPKYTGPRHFDYKPSRTDGYDGVWDSAKANMSMYLLLKERALAFRADPEVQEAMKTSGVFELGETTLNAGESAADLMNDSASFAGFDAEAAAERNFAFIRLNQLAIEHLLGSR

SEQ ID NO: 134 - protein, 393 aa, Actinoplanes missouriensis
SVQATREDKFSFGLWTVGWQARDAFGDATRTALDPVEAVHKLAEIGAYGITFHDDDLVPFGSDAQTRDGIIAGFKKALDETGLIVPMVTTNLFTHPVFKDGGFTSNDRSVRRYAIRKVLRQMDLGAELGAKTLVLWGGREGAEYDSAKDVSAALDRYREALNLLAQYSEDRGYGLRFAIQPKPNEPRGDILLPTAGHAIAFVQELERPELFGINPETGHEQMSNLNFTQGIAQALWHKKLFHIDLNGQHGPKFDQDLVFGHGDLLNAFSLVDLLENGPDGAPAYDGPRHFDYKPSRTEDYDGVWESAKANIRMYLLLKERAKAFRADPEVQEALAASKVAELKTPTLNPGEGYAELLADRSAFEDYDADAVGAKGFGFVKLNQLAIEHLLGAR

SEQ ID NO: 135 - protein, 387 aa, Streptomyces olivochromogenes
MSYQPTPEDRFTFGLWTVGWQGRDPFGDATRPALDPVETVQRLAELGAHGVTFHDDDLIPFGSSDTERESHIKRFRQALDATGMTVPMATTNLFTHPVFKDGGFTANDRDVRRYALRKTIRNIDLAVELGAKTYVAWGGREGAESGAAKDVRVALDRMKEAFDLLGEYVTSQGYDTRFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLESAGYEGPRHFDFKPPRTEDIDGVWASAAGCMRNYLILKERAAAFRADPEVQEALRASRLDELAQPTAADGVQELLADRTAFEDFDVDAAAARGMAFERLDQLAMDHLLGAR

SEQ ID NO: 136 - protein, 386 aa, Streptomyces olivochromogenes
  misc_feature (386)..(386): Xaa can be any naturally occurring amino acid
SYQPTPEDRFTFGLWTVGWQGRDPFGDATRPALDPVETVQRLAELGAHGVTFHDDDLIPFGSSDTERESHIKRFRQALDATGMTVPMATTNLFTHPVFKDGGFTANDRDVRRYALRKTIRNIDLAVELGAKTYVAWGGREGAESGAAKDVRVALDRMKEAFDLLGEYVTSQGYDIRFAIEPKPNEPRGDILLPTVGHALAFIERLERPELYGVNPEVGHEQMAGLNFPHGIAQALWAGKLFHIDLNGQSGIKYDQDLRFGAGDLRAAFWLVDLLESAGYEGPRHFDFKPPRTEDIDGVWASAAGCMRNYLILKERAAAFRADPEVQEALRASRLDELAQPTAADGVQELLADRTAFEDFDVDAAAARGMAFERLDQLAMDHLLGAX

SEQ ID NO: 137 - protein, 394 aa, Streptomyces rochei
MSFQPTPEDKFTFGLWTVGWQGRDPFGDATRPGLDPVETVQRLAELGAYGVTFHDDDLNPFGSSDTERESHIKRFRQALDATGMTVPMATTNLFTHPVFKDRFTANDRDVRAYAVRKTIRNIDLAAELGAKTYVAWGGREGAESGGAKDVRDALDRMKEAFDLLGEYVTAQGYDLRFAIEPKPNEPRGDILLPTVGHALAFIERLERPELYGVNPEVGHEQMAGLNFPHGIAQALWAGKLFHIDLNGQSGIKYDQDCGSRRRPAGGVLVVDLLESAGYEGPRHFDFKPPRTEDFDGVWASAEGCMRNYLILKQPRPPSAPTRRCRRRASAPRVWTSWPSRPLADGLEALLADRTAFEDFDVEAAAARGMVRTPRPAGDGPPAGRARLTVAPRKR

SEQ ID NO: 138 - protein, 386 aa, Streptomyces olivochromogenes
  misc_feature (386)..(386): Xaa can be any naturally occurring amino acid
SYQPTPEDRFTFGLWTVGWQGRDPFGDATRPALDPVETVQRLAELGAHGVTFHDDDLIPFGSSDTERESHIKRFRQALDATGMTVPMATTNLFTHPVFKDGGFTANDRDVRRYALRKTIRNIDLAVELGAKTYVAWGGREGAESGAAKDVRVALDRMKEAFDLLGEYVTSQGYDTRFAIKPKPNEPRGDILLPTVGHALAFIERLERPELYGVNPEVGHEQMAGLNFPHGIAQALWAGKLFHIDLNGQSGIKYDQDLRFGAGDLRAAFWLVDLLESAGYEGPRHFDFKPPRTEDIDGVWASAAGCMRNYLILKERAAAFRADPEVQEALRASRLDELAQPTAADGVQELLADRTAFEDFDVDAAAARGMAFERLDQLAMDHLLGAX

SEQ ID NO: 139 - protein, 387 aa, Streptomyces diastaticus
SYQPTPEDKFTFGLWTVGWQGRDPFGDATRGALDPAESVRRLAELGAHGVTFHDDDLIPFGATDSERAEHIKRFRQALDETGMKVPMATTNLFTHPVFKDGGFTANDRDVRRYALRKTIRNIDLAVELGAQTYVAWGGREGAESGAAKDVRVALDRMKEAFDLLGEYVTSQGYDTPFAIEPKPNEPRGDILLPTIGHALAFIDGLERPELYGVNPEVGHEQMAGLNFPHGIAQALWAGKLFHIDLNGQSGIKYDQDLRFGPGDLRAAFWLVDLLESAGYEGPRHFDFKPPRTEDFDGVWASAAGCMRNYLILKERAAAFRADPEVQEALRAARLDELAQPTAGDGLQALLPDRSAFEDFDPDAAAARGMAFERLDQLAMDHLLGARG

SEQ ID NO: 140 - protein, 393 aa, Actinoplanes missouriensis
SVQATREDKFSFGLWTVGWQARDAFGDATRTALDPVEAVHKLAEIGAYGITFHDDDLVPFGSDAQTRDGIIAGFKKALDETGLIVPMVTTNLFTHPVFKDGGFTSNDRSVRRYAIRKVLRQMDLGAELGAKTLVLWGGREGAEYDSAKDVSAALDRYREALNLLAQYSEDRGYGLRFAIEPKPNEPRGDILLPTAGHAIAFVQELERPELFGINPETGHEQMSNLNFTQGIAQALWHKKLFHIDLNGQHGPRFDQDLVFGHGDLLNAFSLVDLLENGPDGAPAYDGPRHFDYKPSRTEDYDGVWESAKANIRMYLLLKERAKAFRADPEVQEALAASKVAELKTPTLNPGEGYAELLADRSAFEDYDADAVGAKGFGFVKLNQLAIEHLLGAR

SEQ ID NO: 141 - protein, 394 aa, Arthrobacter sp.
SVQPTPADHFTFGLWTVGWTGADPFGVATRKNLDPVEAVHKLAELGAYGITFHDNDLIPFDATEAEREKILGDFNQALKDTGLKVPMVTTNLFSHPVFKDGGFTSNDRSIRRFALAKVLHNIDLAAEMGAETFVMWGGREGSEYDGSKDLAAALDRMREGVDTAAGYIKDKGYNLRIALEPKPNEPRGDIFLPTVGHGLAFIEQLEHGDIVGLNPETGHEQMAGLNFTHGIAQALWAEKLFHIDLNGQRGIKYEQELVFGHGDLTSAFFTVDLLENGFPNGGPKYTGPRHFDYKPSRTDGYDGVWDSAKANMSMYLLLKERALAFRADPEVQEAMKTSGVFELGETTLNAGESAADLMNDSASFAGFDAEAAAERNFAFIRLNQLAIEHLLGSR

SEQ ID NO: 142 - protein, 391 aa, Streptomyces albus
MNYQPTPEDRFTFGLWTVGWEGRDPFGDATRTALDPVESVRRLAELGAHGVTFHDDDLIPFGSSDSERYEHVKRFRQALDDTGMKVPMATTNLFTHPVFKDGGFTANDRDVRRYALRKTIRNIDLAVELGAETYVAWGGREGAESGGAKDVRDALDRMKEAFDLLGEYVTSQGYDIRFAIEPKPNEPRGDILLPTVGHALAFIERLERPELYGVNPEVGHEQMAGLNFPHGIAQALWAGKLFHIDLNGQNGIKYDQDLRFGAGDLRAAFWLVDLLESAGYSGPRHFDFKPPRTEDFDGVWASAAGCMRNYLILKERAAAFRADPEVQEALRASRLDELARPTAADGLQALLDDRSAFEEFDVDAAAARGMAFERLDQLAMDHLLGARGAAA

SEQ ID NO: 143 - protein, 393 aa, Actinoplanes missouriensis
SVQATREDKFSFGLWTVGWQARDAFGDATRTALDPVEAVHKLAEIGAYGITFHDDDLVPFGSDAQTRDGIIAGFKKALDETGLIVPMVTTNLFTHPVFKDGGFTSNDRSVRRYAIRKVLRQMDLGAELGAKTLVLWGGREGAEYDSAKDVSAALDRYREALNLLAQYSEDRGYGLRFAIEPKPNEPRGDILLPTAGHAIAFVQELERPELFGINPETGNEQMSNLNFTQGIAQALWHKKLFHIDLNGQHGPKFDQDLVFGHGDLLNAFSLVDLLENGPDGAPAYDGPRHFDYKPSRTEDYDGVWESAKANIRMYLLLKERAKAFRADPEVQEALAASKVAELKTPTLNPGEGYAELLADRSAFEDYDADAVGAKGFGFVKLNQLAIEHLLGAR

SEQ ID NO: 144 - protein, 387 aa, Streptomyces diastaticus
SYQPTPEDKFTFGLWTVGWQGRDPFGDATRGALDPAESVRRLAELGAHGVTFHDDDLIPFGATDSERAEHIKRFRQGLDETGMKVPMATTNLFTHPVFKDGGFTANDRDVRRYALRKTIRNIDLAVELGAQTYVAWGGREGAESGAAKDVRVALDRMKEAFDLLGEYVTSQGYDTPFAIEPKPNEPRGDILLPTIGHALAFIDGLERPELYGVNPEVGHEQMAGLNFPHGIAQALWAGKLFHIDLNGQSGIKYDQDLRFGPGDLRAAFWLVDLLESAGYEGPRHFDFKPPRTEDFDGVWASAAGCMRNYLILKERAAAFRADPEVQEALRAARLDELAQPTAGDGLQALLPDRSAFEDFDPDAAAARGMAFERLDQLAMDHLLGARG

SEQ ID NO: 145 - protein, 393 aa, Actinoplanes missouriensis
SVQATREDKFSFGLWTVGWQARDAFGDATRTALDPVEAVHKLAEIGAYGITFHDDDLVPFGSDAQTRDGIIAGFKKALDETGLIVPMVTTNLFTHPVFKDGGFTSNDRSVRRYAIRKVLRQMDLGAELGAKTLVLWGGREGAEYDSAKDVSAALDRYREALNLLAQYSEDRGYGLRFAIEPKPNEPRGDILLPTAGHAIAFVQELERPELFGINPETGHEQMSNLNFTQGIAQALWHKKLFHIDLNGQHGPKFAQDLVFGHGDLLNAFSLVDLLENGPDGAPAYDGPRHFDYKPSRTEDYDGVWESAKANIRMYLLLKERAKAFRADPEVQEALAASKVAELKTPTLNPGEGYAELLADRSAFEDYDADAVGAKGFGFVKLNQLAIEHLLGAR

SEQ ID NO: 146 - protein, 388 aa, Streptomyces rubiginosus
MNYQPTPEDRFTFGLWTVGWQGRDPFGDATRRALDPVESVQRLAELGAHGVTFHDDDLIPFGSSDSEREEHVKRFRQALDDTGMKVPMATTNLFTHPVFKDGGFTANDRDVRRYALRKTIRNIDLAVELGAETYVAWGGREGAESGGAKDVRDALDRMKEAFDLLGEYVTSQGYDIRFAIEPKPNEPRGDILLPTVGHALAFIERLERPELYGVNPEVGHEQMAGLNFPHGIAQALWAGKLFHIDLNGQNGIKYDQDLRFGAGDLRAAFWLVDLLESAGYSGPRHFDFKPPRTEDFDGVWASAAGCMRNYLILKERAAAFRADPEVQEALRASRLDELARPTAADGLQALLDDRSAFEEFDVDAAAARGMAFERLDQLAMDHLLGARG

SEQ ID NO: 147 - protein, 393 aa, Actinoplanes missouriensis
SVQATREDKFSFGLWTVGWQARDAFGDATRTALDPVEAVHKLAEIGAYGITFHDDDLVPFGSDAQTRDGIIAGFKKALDETGLIVPMVTTNLFTHPVFKDGGFTSNDRSVRRYAIRKVLRQMDLGAELGAKTLVLWGGREGAEYDSAKDVSAALDRYREALNLLAQYSEDRGYGLRFAIEPKPNQPRGDILLPTAGHAIAFVQELERPELFGINPETGHEQMSNLNFTQGIAQALWHKKLFHIDLNGQHGPKFDQDLVFGHGDLLNAFSLVDLLENGPDGAPAYDGPRHFDYKPSRTEDYDGVWESAKANIRMYLLLKERAKAFRADPEVQEALAASKVAELKTPTLNPGEGYAELLADRSAFEDYDADAVGAKGFGFVKLNQLAIEHLLGAR

SEQ ID NO: 148 - protein, 440 aa, Salmonella enterica
MQAYFDQLDRVRYEGPQSTNPLAFRHYNPDELVLGKRMEDHLRFAACYWHTFCWNGADMFGVGAFNRPWQQPGEALELAKRKADVAFEFFHKLNVPFYCFHDVDVSPEGASLKEYKNNFAQMVDVLAAKQEQSGVKLLWGTANCFTNPRYGAGAATNPDPEVFSWAATQVVTAMNATHKLGGENYVLWGGREGYETLLNTDLRQEREQIGRFMQMVVEHKHKMGFQGTLLIEPKPQEPTKHQYDYDVATVYGFLKQFGLEKEIKVNIEANHATLAGHSFHHEIATAIALGIFGSVDANRGDAQLGWDTDQFPISVEENALVMYEILKAGGFTTGGLNFDAKVRRQSTDKYDLFYGHIGAMDTMALSLKIAARMVEDGELDKRVAKRYAGWNGELGQQILKGQLSLGELAQYAEQHNLAPVHQSGHQELLENLVNRYLFDK

SEQ ID NO: 149 - protein, 440 aa, Klebsiella pneumoniae
MQTYFDQLDRVRYEGPKSTNPLAFRHYNPDELVLGKRMEDHLRFAACYWHTFCWNGADMFGVGSFDRPWQQPGDALEMAKRKADVAFEFFHKLNVPYYCFHDVDVSPEGASLKEYSNNFARMVEVLAEKQQQSGVKLLWGTANCFTNPRYGAGAATNPDPEVFSWAATQVVTAMNATHQLGGENYVLWGGREGYETLLNTDLRQEREQLGRLLQLVVEHKHKIGFKGTLLIEPKPQEPTKHQYDYDASTVYGFLKQFGLEKEIKLNIEANHATLAGHSFHHEIATAIALGLFGSVDANRGDPQLGWDTDQFPNRVEEDALVMYEIFKAGGFTTGGLNFDAKVRRQSTDKYDLFYGHIGAMDTMAVSLKVAARMIEDGELDKRVARRYAGWNGELGQQILNGQMTLSDIAQYAAQHQLAPQHRSGQQEQLENLVNHYLFDK

SEQ ID NO: 150 - protein, 436 aa, Sinorhizobium meliloti
MSTGFFGDIAKIKYEGPESTNPLAFRHYNPDDVVLGKRMEDHLRFAVAYWHTFVWPGGDPFGGQTFERPWFKDSMEAAKLKADVAFEFFQLLGVPYYCFHDADVRPEGRNFAENTSNLNAIVDYFAGKQGETGVKLLWGTANLFSNRRFMAGAATNPDPDVFAFAAATVKTCIDATQRLDGENYVLWGGREGYETLLNTDLKRELDQLGRFLNLVVEYKHRIGFKGTILIEPKPQEPTKHQYDYDVATVYGFLKRYGLENEVKVNIEQGHAILAGHSFEHELALANALGIFGSIDMNRNDYQSGWDTDQFPNNVPEMALAYYHVLAGGGFKTGGTNFDAKLRRQSIDPEDLLIGHIGGMDCCARGLKAAAKMIEDKALSAPLEARYAGWNVPEAKKMLDGGFSLEEIEAWVLKSDVNPQPKSGRQELLENVVNRYV

SEQ ID NO: 151 - protein, 440 aa, Escherichia coli
MQAYFDQLDRVRYEGSKSSNPLAFRHYNPDELVLGKRMEEHLRFAACYWHTFCWNGADMFGVGAFNRPWQQPGEALALAKRKADVAFEFFHKLHVPFYCFHDVDVSPEGASLKEYINNFAQMVDVLAGKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAACMIEDGELDKRIAQRYSGWNSELGQQILKGQMSLADLAKYAQEHNLSPVHQSGRQEQLENLVNHYLFDK

SEQ ID NO: 152 - protein, 425 aa, Salmonella enterica
MQAYFDQLDRVRYEGPQSTNPLAFRHYNPDELVLGKRMEDHLRFAACYWHTFCWNGADMFGVGAFNRPWQQPGEALELAKRKADVAFEFFHKLNVPFYCFHDVDVSPEGASLKEYKNNFAQMVDVLAAKQEQSGVKLLWGTANCFTNPRYGAGAATNPDPEVFSCAATQVVTAMNATHKLGGENYVLWGGREGYETLLNTDLRQEREQIGRFMQMVVEHKHKMGFQGTLLIEPKPQEPTKHQYDYDVATVYGFLKQFGLEKEIKVNIEANHATLAGHSFHHEIATAIALGIFGSVDANRGDAQLGWDTDQFPISVEENALVMYEILKAGGFTTGGLNFDAKVRRQSTDKYDLFYGHIGAMDTMALSLKIAARMVEDGELGQQILKGQLSLGKLAQYAEQHHLAPVHQSGHQELLENLVNRYLFDK

SEQ ID NO: 153 - protein, 445 aa, Xanthomonas campestris
MSNTVYIGAKEYFPGIGKIGFEGRDSDNPLAFKVYDANKTIGDKTMAEHLRFAVAYWHSFCGNGADPFGPGTRAYPWDAGTTALNRAEAKADAAFEFFTKLGVPYYCFHDIDLAPDADDIGEYEKNLKHMVGIAKQRQADTGIKLLWGTANLFSHPRYMNGASTNPDFNVVARAAVQVKAAIDATVELGGENYVFWGGREGYACLHNTQMKREQDNMARFLTLARDYGRAIGFKGNFLIEPKPMEPMKHQYDFDSATVIGFLRQHGLDQDFKLNIEANHATLSGHSFEHDLQVASDAGLLGSIDANRGNPQNGWDTDQFPTDLYDTVGAMLVVLRQGGLAPGGLNFDAKVRRESSDPQDLFLAHIGGMDAFARGLEVANALLTASPLEQWRAERYASFDSGAGADFAAGKTTLADLAKHAASNAPQQLSGRQEAYENLINQYLTR

SEQ ID NO: 154 - protein, 439 aa, Pectobacterium atrosepticum
MQAYFEQIEKVRYEGSQSSNPFAFRHYNPDQEILGKRMADHLRFAVAYWHTFCWNGSDMFGVGSFARPWQQSGDALELAKRKADIAFEFFQKLSVPYYCFHDVDVAPEGNSLKEYLHNIAVITDVLAEKQQDSGVKLLWGTANCFTNPRYGAGAATNPDPDVFAWAATQVFTAMNATKTLGGENYVLWGGREGYETLLNTDLRQEREQIGRFMQMVVEHKHKIGFQGTLLIEPKPQEPTKHQYDYDVATVYGFLKQFGLEKEIKVNVEANHATLAGHSFHHEIATAVALGVFGSVDANRGDPQLGWDTDQFPNSVEENTLIMYEILKAGGFTTGGLNFDAKVRRQSTDRYDLFHAHIGAMDTMALALKAAARMIEDDKLNQLVAKRYAGWNGELGQQILQGNASLESLAQYAESHQLAPQHQSGQQELLENLVNRHLFG

SEQ ID NO: 155 - protein, 439 aa, Rhodopirellula baltica
MTAFPDVPVIQYEGPQSDNPLAFRWYNPDEVIEGKTMKDHMRFSIVYWHTFRGTGADPFGPGTAVRPWDNGSESVENAQKRAVVAFELFTKLQAPYYAWHDRDVAPEGANLRETHANLDAVADVLEEQQKATGVKLLWGTANMFSNPRFMHGAATSCNADVFAYAGAQVKKALEVTKRLGGENYVFWGGREGYQNLYNTDMKRELDHLAKFFHMAVDYAKSIGFDGQFLIEPKPKEPTKHQYDSDAAACMNFLRAYDLDSHFKLNIETNHATLAGHTMMHELDYAGIQGGLGSIDANTGDLLLGWDTDQFPTDYYLTTQTMLMILKHGGIGTGGVNFDAKVRRESFEPIDLFHAHIGGMDAFAKGLKIAAAIRASGELADFVKNRYSTWDSGIGAKIEAGEVGFAELEAYMLEKGDVDANQSGRQEYLEHMINKYIDRV

SEQ ID NO: 156 - protein, 445 aa, Xanthomonas axonopodis
MSNTVYIGAKEYFPGIGKIGFEGRDSDNPLAFKVYDANKTIGDKTMAEHLRFAVAYWHSFCGNGADPFGPGTRAYPWDVGDTALNRAEAKADAAFEFFTKLGVPYYCFHDIDLSPDADDITEYESNLKHMVGVAKQRQADTGIKLLWGTANLFSHPRYMNGASTNPDFNVVARAAVQVKAAIDATVALGGENYVFWGGREGYACLHNTQMKREQDNMARFLTLARDYGRSIGFKGNFLIEPKPMEPMKHQYDFDSATVIGFLRQHGLDQDFKLNIEANHATLSGHSFEHDLQVASDAGLLGSIDANRGNPQNGWDTDQFPTDLYDTVGAMLVVLRQGGLAPGGLNFDAKVRRESSDPQDLFLAHIGGMDAFARGLEVANALLTASPLEQWRAERYASFDSGAGADFAAGKTTLADLAKHAAGNAPQQISGRQEAYENLINQYLTR

SEQ ID NO: 157 - protein, 445 aa, Xanthomonas oryzae
MSNTVYIGAKEYFPGIGKIGFEGRESDNPLAFKVYDANKTIGDKTMAEHLRFAVAYWHSFCGNGADPFGPGTRAYPWDVGNSALARAEAKSDAAFEFFTKLGVPYYCFHDIDLSPDADDIGEYESNLKHMVGVAKQRQADTGIKLLWGTANLFSHPRYMNGASTNPDFNVVARAAVQVKAAIDATVELGGENYVFWGGREGYACLHNTQMKREQDNMARFLTLARDYGRSIGFTGNFLIEPKPMEPMKHQYDFDSATVIGFLRQHGLDQDFKLNIEANHATLSGHSFEHDLQVASDAGLLGSIDANRGNPQNGWDTDQFPTDLYDTVGAMLVVLRQGGLAPGGLNFDAKVRRESSDPQDLFLAHIGGMDAFARGLEVANALLTSSPLEQWRAERYASFDNGTGADFAAGKITLADLAAHAAGNAPKQISGRQEAYENLINQYLTR

SEQ ID NO: 158 - protein, 447 aa, Pediococcus pentosaceus
MSEYYDFNKMEYIGNQKGLKAGDGFHYYNPDELIQGKKMSEWLKFSVAYWHTMDQRLVDPFGDGTAQRPWDKFEDPMEQALAKVDYMFEFLDKMNVEYFAFHDRDLAPEGNTLRETNANLDKVVDKIVEKMQETGKKVLWNTSSLFTNPRFVAGGATAPFADIVAYSAAQIKHSLEIAKRVNSMNYVFWGGREGYESLLNTDMKLEQEHIAKFFHMAKDYANEIGYTGQFLLEPKPKEPTSHQYDTDAATTIAFLKTYGLEKDFKLNLEGNHAYLAGHTYEHEVRVARDAGLLGSLDANMGDKLIGWDIDEFPNDIYEATLVMYEMLKNGGLATGGLNFDAKPRRQSFTMEDLFLAHTAGMDTYAAGLRVAAKLLEDRVFDSVIEDRYSSFKSGIGADFENDKVTFKELEDYVIDKPQSELIAATKSGHLEQLKSTLNNYIFTVLGK

SEQ ID NO: 159 - protein, 435 aa, Brucella suis
MSTGFFGDIQKVRYEGPESDNPLAFRHYNADEIVLGKRMEDHLRFAVAYWHSFAWEGGDPFGGRTFDRPWFSNEIDAAKLKADVAFEFFSLLGAPYYCFHDADVRPEGRNFAENTRYLNEIVDIFEKKQAETGMKLLWGTANLFSNRRYMAGAATNPDPDVFAFAAATVKTCIDATKRLGGENYVLWGGREGYETLLNTDLSRELDHMGRFLSLVVEYKHKIGFKGTILIEPKPQEPTKHQYDYDVATVYGFLKRYGLENEVKVNIEQGHAILAGHSFEHELALARTLGIFGSIDMNRNDYQSGWDTDQFPNNVPEMALAYYQVLLAGGFTTGGTNFDAKLRRQSLDSQDLLIGHIGGMDCCARGLKAAARMLEDGALSKPLDERYAGWNGEFGKRLLSGLSLDQIAGEVEAKDINPQPKSGRQEYLENIVNHYV

SEQ ID NO: 160 - protein, 440 aa, Escherichia coli
MQAYFDQLDRVRYEGSKSSNPLAFRHYNPDELVLGKRMEEHLRFAACYWHTFCWNGADMFGVGAFNRPWQQPGEALALAKRKADVAFEFFHKLHVPFYCFHDVDVSPEGASLKEYINNFAQMVDVLAGKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAARMIEDGELDKRIAQRYSGWNSELGQQILKGQMSLADLAKYAQEHNLSPVHQSGRQEQLENLVNHYLFDK

SEQ ID NO: 161 - protein, 449 aa, Bifidobacterium longum
MGLWDVDKIEYVGRAKGPKEDFAFHYYDADKVVAGKKMKDWLRFGVAWWHTFNQELVDPFGTGTAHRPYYKYTDPMDQALAKVDYAFELFQKLGVEYFCFHDRDIAPEGDTLRETNANLDKVVDKIEENMKSTGVKLLWNTSSLFTNPRFVSGAATSPFADIYAYAGGQLKKSLEIGKRLGAENYVFWGGREGYENLWNTEMKRETDHIAKFFHMCADYAKEIGFEAQFLIEPKPKEPTLHQYDFDAATAIEFLRNHDLTDVFKLNLEGNHANLAGHTYQHEIRVARESGFLGSLDANQGDKLIGWDMDEFPTDLYETVAVMWEVLQAGSIGPHGGLNFDAKPRRTSFYEEDLFRSHIAGMDAYAAGLLVADKMNQDGFIQNLQAERYSSYDSGIGKDIDEGNVTLADLEAYSLDKPQSELIAATKSDHLESVKATINNYIIDALAEVE

SEQ ID NO: 162 - protein, 435 aa, Brucella canis
MSTGFFGDIQKVRYEGPESDNPLAFRHYNADEIVLGKRMEDHLRFAVAYWHSFAWEGGDPFGGRPFDRPWFSNEIDAAKLKADVAFEFFSLLGAPYYCFHDADVRPEGRNFAENTRYLNEIVDIFEKKQAETGMKLLWGTANLFSNRRYMAGAATNPDPDVFAFAAATVKTCIDATKRLGGENYVLWGGREGYETLLNTDLSRELDHMGRFLSLVVEYKHKIGFKGTILIEPKPQEPTKHQYDYDVATVYGFLKRYGLENEVKVNIEQGHAILAGHSFEHELALARTLGIFGSIDMNRNDYQSGWDTDQFPNNVPEMALAYYQVLLAGGFTTGGTNFDAKLRRQSLDPQDLLIGHIGGMDCCARGLKAAARMLEDGALSKPLDERYAGWNGEFGKRLLSGLSLDQIAGEVEAKDINPQPKSGRQEYLENIVNRYV

SEQ ID NO: 163 - protein, 440 aa, Burkholderia multivorans
MSYFEHIPAIRYEGPQSDNPLAYHHYDRTKRVLGKTLEEHLRIAVCYWHTFVWPGHDIFGQGAFRRPWQQPGDALERARQKADAAFEFFTKLGTPFYTFHDTDVAPEGDSLREYVDNFARMVDYLGERQQASGVRLLWGTANLFSHPRFAAGAATNPNPDVFAWAATQVRHALDATHRLGGENYVLWGGREGYETLLNTDLKREREQFARFLSMVVEHKHRIGFRGALLIEPKPQEPTKHQYDYDVATVHGFLTQYGLQDEIRVNIEANHATLAGHSFHHEIANAFALGVFGSVDANRGDPQNGWDTDQFPNSVEELTLAFYEILRHGGFTTGGMNFDAKVRRQSVDPEDLFYGHVGAIDVLALALERAAVLVENDRLEAMRRQRYAQWDDAFGRKILSGGYTLESLAADALARGVNPQHASGAQERLENIVNQAIYALR

SEQ ID NO: 164 - protein, 435 aa, Brucella ovis
MSTGFFGDIQKVRYEGPESDNPLAFRHYNADEIVLGKRMEDHLRFAVAYWHSFAWEGGDPFGGRTFDRPWFSNEIDAAKLKADVAFEFFSLLGAPYYCFHDADVRPEGRNFAENTRYLNEIVDIFEKKQAETGMKLLWGTANLFSNRRYMAGAATNPDPDVFAFAAATVKTCIDATKRLGGENYVLWGGREGYETLLNTDLSRELDHMGRFLSLVVEYKHKIGFKGTILIEPKPQAPTKHQYDYDVATVYGFLKRYGLENEVKVNIEQGHAILAGHSFEHELALARTLGIFGSIDMNRNDYQSGWDTDQFPNNVPEMALAYYQVLLAGGFTTGGTNFDAKLRRQSLDPQDLLIGHIGGMDCCARGLKASARMLEDGALSKPLDERYAGWNGEFGKRLLSGLSLDQIAGEVEAKDINPQPKSGRQEYLENIVNRYV

SEQ ID NO: 165 - protein, 436 aa, Rhizobium etli
MSTGFFGDIQKIKYEGPDSTNPLAFRHYQPDEIVLGKRMEDHLRFAVAYWHTFTWPGGDPFGGQTFLRPWFEDTMKAAKLKADVAFEFFSLLGAPYYCFHDADVRPEGRNFAENTKNLNEIVDYFAEKQAATGTKLLWGTANLFSNRRYMSGAATNPDPDVFAFAAATVKTCIDATQKLGGENYVLWGGREGYETLLNTDLKRELDQLGRFLNLVVEYKHKIGFKGTILIEPKPQEPTKHQYDYDVATVYGFLKKHGVENEVKVNIEQGHAILAGHSFEHELALANALGIFGSIDMNRNDYQSGWDTDQFPNNVPEMALAYYHVLAGGGFKTGGTNFDAKLRRQSLDPADLLIGHIGGMDCCARGLKAAAKMIEDKALSQPLADRYAGWESAEAQKLFRGEYSLDEITNWVESHDVNPQPKSGKQELLENVVNRYV

SEQ ID NO: 166 - protein, 440 aa, Burkholderia xenovorans
MSYFEHIPEIRYEGPQSDNPLAYRHYDKSKKVLGKTLEEHLRIAVCYWHTFVWPGVDIFGQGTFRRPWQQAGDAMERARQKADSAFEFFSKLGTPYYTFHDTDVSPEGSSLKEYSENFLRITDYLARKQEDTGIKLLWGTANLFSHPRYAAGAATSPDPEVFAFAATQVRHALDATQRLGGDNYVLWGGREGYDTLLNTDLMRERDQLARFLHMVVDHAHKIGFKGSLLIEPKPQEPTKHQYDYDVATVHGFLLQHGLEKEIRVNIEANHATLAGHSFHHEIATAYALGIFGSVDANRGDPQNGWDTDQFPNSVEELTLAFYEILKHGGFTTGGMNFDSKVRRQSVDPEDLFYGHIGAIDNLALAVERAAVLIENDRLDQFKRQRYAGWDADFGRKILSGDYSLSTLATDALARGLNPQHASGHQELMENIVNQAIYSGR

SEQ ID NO: 167 - protein, 439 aa, Actinobacillus pleuropneumoniae
MSNYFDKIEKVKYEGADSTNPFAFKHYNPNEVILGKTMAEHLRLAVCYWHTFCWTGNDMFGVGSLDRSWQKTGDLLEGAKQKAEIAFEFFQKLGIPYYCFHDVDIAPEGNSYKEYVHNFHTMVDILEKKQAETGVKLLWGTANCFTNPRYMSGASTNPNPEVFSWAASQVFNAMNATKRLGGENYVLWGGREGYETLLNTDLKREREQIGRFMQMVVEHKHKIGFNGTLLIEPKPQEPTKHQYDYDVATVYGFLKQFGLEKEIKVNIEANHATLAGHTFQHEIATAAALDIFGSIDANRGDPQLGWDTDQFPNSVEENTLVMYEILKAGGFTTGGFNFDAKIRRQSTDPYDLFHGHIGAIDVLALSLKRAAKMIEDKTLQGIVDQRYAGWNGDLGQQILAGKASLEDLAKIVESKALDPKPVSGQQEYLENLVNNYIYR

SEQ ID NO: 168 - protein, 440 aa, Burkholderia cenocepacia
MSYFEHIPAIRYEGPQSDNPLAYHHYDPDKRVLGKTLAEHLRIAVCYWHTFVWPGHDIFGQAAFRRPWQQPGDALERARMKADAAFEFFTKLGTPFYTFHDTDVAPEGDSLREYAANFARMVDYLGERQQASGVRLLWGTANLFSHPRFAAGAATNPNPDVFAWAATQVCHALDATHRLGGENYVLWGGREGYETLLNTDLKRERDQFARFLSMVVEHKHRIGFKGALLIEPKPQEPTKHQYDYDVATVHGFLVQYGLQNEIRVNIEANHATLAGHSFHHEIANAFALGVFGSVDANRGDPQNGWDTDQFPNSVEELTLAFYEILRHGGFTTGGMNFDAKVRRQSIDPEDLFYGHVGAIDVLALALERAAVLVENDRLDALRRQRYAQWDDAFGRKILAGGYTLESLAADALARGVDPQHASGAQERLENIVNQAIYGLR

SEQ ID NO: 169 - protein, 438 aa, Solibacter usitatus
MTESYFASIAPIEFEGAASENPLAYRYYDKNRVVLGKRMEDHLRMAVCYWHTFCSEGADMFGPGTFHRPWHIGPMDQAHAEHKLNEAFEFFTRLGLPFFCFHDTDVMAEAHTIREHVDNLARIGDRIQEKMAATGVKLLWGTANLFSHPRYMAGAASNPDPDVFRFAATQVRHCMDLTKRLGGQNYVLWGGREGYDSLLNTDLKQEKAQLGRFLKMVIEHKHKIGFSGTILIEPKPHEPTKHQYDFDVETVYSFLVANGLEKEVKLNIEANHATLAGHSFEHEIATAVALGVFGSIDMNRGDPQNGWDTDQFPNDVREITTALYYILLGGGFTTGGNNFDAKVRRQSFEPADLFYAHVGAVDTVAQGLINAAAMIEGGQLAGIVKERYAGWQGELGRAILDGKMSLEALSDGAVAEGITPRPRSGRQEMIENLVGRYL

SEQ ID NO: 170 - protein, 435 aa, Brucella abortus
MSTGFFGDIQKVRYEGPESDNPLAFRHYNADEIVLGKRMEDHLRFAVAYWHSFAWEGGDPFGGRTFDRPWFSNEIDAAKLKADVAFEFFSLLGAPYYCFHDADVRPEGRNFAENTRYLNEIVDIFEKKQAETGMKLLWGTANLFSNRRYMAGAATNPDPDVFAFAAATVKTCIDATKRLGGENYVLWGGREGYETLLNTDLSRELDHMGRFLSLVVEYKHKIGFKGTILIEPKPQEPTKHQYDYDVATVYGFLKRYGLENEVKVNIEQGHAILAGHSFEHELALARTLGIFGSIDMNRNDYQSGWDTDQFPNNVPEMALAYYQVLLAGGFTTGGTNFDAKLRRQSLDPQDLLIGHIGGMDCCARGLKAAARMLEDGALSKPLDERYAGWNGEFGKRLLSGLSLDQIAGEVEAKDINPQPKSGRQEYLENIVNRYV

SEQ ID NO: 171 - protein, 433 aa, Rhodobacter sphaeroides
MTDFFAGIPQIRYEGEGSSNEFAYRHYNPDEMILGKRMEDHLRFAVAWWHSFAWPGGDPFGAQTLERPWFGDTLDLARMKADVAFEMFEILGAPFFCFHDADIRPEGATFAESKRNLEAIVDHIGARMERSKTRLLWGTANLFSHRRFMSGAATNPDPDVFAWSAATVKACMDATKKLGGANYVLWGGREGYETLLNTDLKREAEQAGRFLQMVVDYKYKIGFEGTILIEPKPQEPSKHQYDYDVATVYGFLKRFGLENEVKLNVEQGHAILAGHSFEHELALAASLGILGSIDMNRNDYQSGWDTDQFPNNHPEMALAYYEVLRAGGFTTGGTNFDAKIRRQSLDPEDLILAHVGGMDTCARALKAAARLYEDGSLERARADRYAGWETPEAKAMLSSSLEEIEARVLAEDINPQPRSGRQERLENLWNRFV

SEQ ID NO: 172 - protein, 438 aa, Thermoanaerobacter sp.
MEYFKNVPQIKYEGPKSNNPYAFKFYNPDEIIDGKPLKEHLRFSVAYWHTFTANGTDPFGAPTMQRPWDHFTDPMDIAKARVEAAFELFEKLDVPFFCFHDRDIAPEGETLRETNKNLDTIVAMIKDYLKTSKTKVLWGTANLFSNPRFVHGAATSCNADVFAYAAAQVKKALEITKELGGQNYVFWGGREGYETLLNTDMELELDNLARFLHMAVEYAQEIGFEGQFLIEPKPKEPTKHQYDFDAASVHAFLKKYDLDKYFKLNIEANHATLAGHDFQHELRYARINNILGSIDANMGDMLLGWDTDQYPTDIRMTTLAMYEVIKMGGFNKGGLNFDAKVRRASFEPEDLFLGHIAGMDAFAKGFKVAYKLVKDGVFDRFIEERYKSYREGIGAEIVSGKANFKTLEEYALNNPKIENKSGKQELLESILNQYLFSE

SEQ ID NO: 173 - protein, 439 aa, Yersinia pseudotuberculosis
MQSYFNELEQVRYEGSQSTNPLAFHHYNPDEMILGKRMADHLRFAACYWHTFCWGGADMFGANAFDRPWQQPGDALALAKRKAEVAFEFFHKLNVPYYCFHDVDVSPEGASLQEYLNNFAVMTDVLAEKQAASGVKLLWGTANCFTHPRYGAGAATNPDPEVFSWAATQVFTAMNATRQLGGENYVLWGGREGYETLLNTDLRQEREQIGRFMQMVVEHKHKTGFQGTLLIEPKPQEPTKHQYDYDVATVYGFLKQFGLEKEIKVNIEANHATLAGHSFHHEIASAIALGIFGSVDANRGDPQLGWDTDQFPNSVEENTLVMFEILKAGGFTTGGLNFDAKVRRQSTDKYDLFYGHIGAMDTMALALKFAAKMIEDGQLDQIVAKRYAGWNSELGQQILQGKMSLEELSRYASQHNLNPQHQSGHQELLENKVNRYLFG

SEQ ID NO: 174 - protein, 445 aa, Xanthomonas oryzae; identical to SEQ ID NO: 157

SEQ ID NO: 175 - protein, 449 aa, Bifidobacterium longum
MGLWDVDKIEYVGRAKGPKEDFAFHYYDADKVVAGKKMKDWLRFGVAWWHTFNQELVDPFGTGTAHRPYYKYTDPMDQALAKVDYAFELFQKLGVEYFCFHDRDIAPEGDTLRETNANLDKVVDKIEENMKSTGVKLLWNTSSLFTNPRFVSGAATSPFADIYAYAGGQLKKSLEIGKRLGAENYVFWGGREGYENLWNTEMKRETDHIAKFFHMCADYAKEIGFEAQFLIEPKPKEPTLHQYDFDAATAIEFLRNHDLTDVFKLNLEGNHANLAGHTYQHEIRVARESGFLGSLDANQGDKLIGWDMDEFPTDLYETVAVMWEVLQAGSIGPHGGLNFDAKPRRTSFYEEDLFRSHIAGMDTYAAGLLVADKMNQDGFIQDLMAERYSSYDSGIGKDIDEGNVTLADLEAYSLDKPQSELIAATKSDHLESVKATINNYIIDALSEVE

SEQ ID NO: 176 - protein, 438 aa, Thermoanaerobacter pseudethanolicus
MEYFKNVPQIKYEGPKSNNPYAFKFYNPDEIIDGKPLKEHLRFSVAYWHTFTANGTDPFGAPTMQRPWDHFTDPMDIAKARVEAAFELFEKLDVPFFCFHDRDIAPEGETLRETNKNLDTIVAMIKDYLKTSKTKVLWGTANLFSNPRFVHGAATSCNADVFAYAAAQVKKALEITKELGGQNYVFWGGREGYETLLNTDMELELDNLARFLHMAVEYAQEIGFEGQFLIEPKPKEPTKHQYDFDAASVHAFLKKYDLDKYFKLNIEANHATLAGHDFQHELRYARINNMLGSIDANMGDMLLGWDTDQYPTDIRMTTLAMYEVIKMGGFNKGGLNFDAKVRRASFEPEDLFLGHIAGMDAFAKGFKVAYKLVKDGVFDRFIEERYKSYREGIGAEIVSGKANFKTLEEYALNNPKIENKSGKQELLESILNQYLFSE

SEQ ID NO: 177 - protein, 439 aa, Photobacterium profundum
MTEFFKNINKIQFEGTDAINPLAFRHYDAERMILGKSMKEHLRFAACYWHNFCWPGSDVFGAATFDRPWLQSGNAMEMAHMKADAAFDFFSKLGVPYYCFHDTDIAPEGTSLKEYVNNFAQMVDVLEQKQDETGLKLLWGTANAFSNPRYMSGAGTNPDPKVFAYAATQIFNAMGATQRLGGENYVLWGGREGYETLLNTDLRQEREQLGRLMQMVVEHKHKIGFKGTILIEPKPQEPTKHQYDYDTATVYGFLKQFGLENEIKVNIEANHATLAGHSFQHEIATATSLGLFGSIDANRGDPQLGWDTDQFPNSVEENTLVMYEILKAGGFTTGGFNFDSHVRRPSIDAEDLFYGHIGGMDTMALALERAANMIENDVLSKNIAQRYAGWNEDLGKKILSGDHSLETLAKFALDSNIAPVKESGRQEHLENIVNGFIYK

SEQ ID NO: 178 - protein, 440 aa, Escherichia coli; identical to SEQ ID NO: 160

SEQ ID NO: 179 - protein, 436 aa, Agrobacterium tumefaciens
MSTGFFGDIAKIKYEGPDSTNPLAFRHYNPDEIVGGKRMEDHLRFAVAYWHTFTWPGGDPFGGQTFQRPWFEDTMQAAKLKADVAFEFFSLLGSPFYCFHDADVRPEGKNFAENTKNLNEIVDYFAQKQADTGVKLLWGTANLFSNRRFMSGAATNPDPDVFAFSAATVKTCMDATKTLGGANYVLWGGREGYETLLNTDLSRELDQLGRFLNLVVEYKYKIGFEGTILIEPKPQEPTKHQYDYDVATVYAFLQKNGLEKEVKVNIEQGHAILAGHSFEHELAMANAFGIFGSIDMNRNDYQSGWDTDQFPNNVPEMALAYYHVLAGGGFKNGGTNFDSKLRRQSLDPQDLLIGHIGGMDCCARGLKAAAKMIEDGALSKPLSERYAKWDSPEAQKMLRGELKLEEIAALVERDDINPEPKPGRQEYLENVVNRYV

SEQ ID NO: 180 - protein, 435 aa, Tetragenococcus halophilus
MDYFENVPKVQYEGKNAKSKYAFRHYNPEEIIMGKPMKDHLRFSVAFWHTMTEDGSDPFGDGTYQRNWEGSTPMETAKNRVDAFFEILEKLGAEYFCFHDVDIAPQGDSLKEFLENIDVMTDYIKGKMDKTGVKLLWNTANMFTHPTFVNGAATTNNADVYSMAAAQVKKGLDVSKKLNGENYVFWGGREGYENLLNTDMNFELDNLARFYQMVIDYAQKIDYHPQFLIEPKPKEPTKHQYDYDAATAMAFIQKYNLEDSFKLNLEANHATLAGHTFEHELNVAKNYNALGSLDANQGDLLLGWDTDEFPTDIYTATLAMYEVLDFGGIAPGGLNFDAKVRRTSFAMDDLILAHIAGMDTYARGLRAAAKMKDDNFFEQIIANRYESFSSGIGKQIVENKEDLESLTNYALSLNGVENKSGHIEHLKSLLNDYLV

SEQ ID NO: 181 - protein, 440 aa, Salmonella enterica; identical to SEQ ID NO: 148

SEQ ID NO: 182 - protein, 439 aa, Yersinia pseudotuberculosis; identical to SEQ ID NO: 173

SEQ ID NO: 183 - protein, 439 aa, Yersinia pseudotuberculosis; identical to SEQ ID NO: 173

SEQ ID NO: 184 - protein, 433 aa, Rhodobacter sphaeroides
MTDFFAGIPQIRYEGEGSSNEFAFRHYNPDEVILGKRMEEHLRFAVAWWHSFAWPGGDPFGGQTFNRPWFGDTLDLAKLKADVAFEMFDILGAPFFCFHDADIRPEGATFAESKRNLEEIVDHIGTRMEGSKTKLLWGTANLFSHRRFMSGAATNPDPDVFAWSAATVKGCMDATMKLGGANYVLWGGREGYETLLNTDLTREAENAGRFLQMVVDYKHKIGFQGTILIEPKPQEPSKHQYDYDVATVYGFLKRFGLEKEVKLNIEQGHAILAGHSFEHELALAASLGILGSIDMNRNDYQSGWDTDQFPHNHPEMALAYYEILRAGGFTTGGTNFDAKIRRQSLDPEDLVLAHVGGMDTCARALKAAARLYEDGSLEAARAARYAGWETPEAQAMLASSLEEIEARVLAEGINPEPRSGRQERLENLWNRFV

SEQ ID NO: 185 - protein, 435 aa, Brucella abortus; identical to SEQ ID NO: 170

SEQ ID NO: 186 - protein, 440 aa, Salmonella enterica; identical to SEQ ID NO: 148

SEQ ID NO: 187 - protein, 438 aa, Bacteroides vulgatus
MATKEYFPGIGKIKFEGKESKNPMAFRYYDAEKVINGKKMKDWLKFAMAWWHTLCAEGGDQFGGGTKKFPWNGDADKVQAAKNKMDAGFEFMQKMGIEYYCFHDVDLCEEADTIEEYEANLKEIVAYAKQKQAETGIKLLWGTANVFGHARYMNGAATNPEFDVVARAAVQIKNAIDATIELGGSNYVFWGGREGYMSLLNTDQKREKEHLAQMLTIARDYARSKGFTGTFLIEPKPMEPTKHQYDVDTETVVGFLKTHGLDKDFKVNIEVNHATLAGHTFEHELAVAVDNGMLGSIDANRGDYQNGWDTDQFPIDNYELTQAMMQIIRNGGLGNGGTNFDAKTRRNSTDLEDIFIAHIAGMDAMARALESAAALLNESPYCKMLSDRYASFDSGKGKEFEEGKLTLEDVVAYAKQNGEPKQVSGKQELYEAIVNMYC

SEQ ID NO: 188 - protein, 441 aa, Xanthomonas axonopodis
MYIGAKEYFPGIGKIGFEGRDSDNPLAFKVYDANKTIGDKTMAEHLRFAVAYWHSFCGNGADPFGPGTRAYPWDVGDTALNRAEAKADAAFEFFTKLGVPYYCFHDIDLSPDADDITEYESNLKHMVGVARQRQADTGIKLLWGTANLFSHPRYMNGASTNPDFNVVARAAVQVKAAIDATVALGGENYVFWGGREGYACLHNTQMKREQDNMARFLTLARDYGRSIGFKGNFLIEPKPMEPMKHQYDFDSATVIGFLRQHGLDQDFKLNIEANHATLSGHSFEHDLQVASDAGLLGSIDANRGNAQNGWDTDQFPTDLYDTVGAMLVVLRQGGLAPGGLNFDAKVRRESSDPQDLFLAHIGGMDAFARGLEVANALLTASPLEQWRAERYASFDSGAGADFAAGKTTLADLAKHAAGNAPQQISGRQEAYENLINQYLTR

SEQ ID NO: 189 - protein, 440 aa, Salmonella enterica; identical to SEQ ID NO: 148

SEQ ID NO: 190 - protein, 440 aa, Escherichia coli; identical to SEQ ID NO: 160

SEQ ID NO: 191 - protein, 433 aa, Roseobacter denitrificans
MTDFFKDIPAIRYEGPDTENEFAFRHYNPDEVVMGKTLKDHLRFACAYWHSFAWPGGDPFGGQTFERPWFGDTMELAKLKADVAFDMFERLGVPYFCFHDADVRPEGDTFAESTKNLEEITDYFAEKMDATGVKLLWGTANLFSHRRFMAGAATNPDPEVFAYSAATIKSCMDATRKLGGENYVLWGGREGYETLLNTDMARERAQAGRMLQMVVDYKHKTGFAGTILIEPKPQEPTKHQYDYDVATVYGFLKDFGLEGEVKVNIEQGHAILAGHSFEHELALARALGIFGSIDMNRNDYQSGWDTDQFPNNVPEMALAYYEVLRAGGFDTGGTNFDAKLRRQSLDPADLILAHVGGMDACAAGLKAAAAMLEDGKLEAAREARYAGWSEGLGQKLLTSDLAEISDLVIAKGINPQPRSGRQERLENLVNKYL

SEQ ID NO: 192 - protein, 439 aa, Bacteroides fragilis
MATKEYFPGIGKIKFEGKDSKNPMAFRYYDAEKMINGRSMKDWLKFAMAWWHTLCAEGGDQFGGGTKQFPWNGDPDPVQAAKNKMDAGFEFMQKMGIGYYCFHDVDLVTEADSIEAYEANLKELVAYAKQKQAETGIKLLWGTANVFSHARYMNGAATNPDFDVVARAAVQIKNAIDATIELGGTNYVFWGGREGYMSLLNTDQKREKEHLAQMLTIARDYGRARGFKGTFLIEPKPMEPTKHQYDVDTETVIGFLKAHGLDQDFKVNIEVNHATLAGHTFEHELAVAVDNGMLGSIDANRGDYQNGWDTDQFPIDNFELTQAMMQIIRNDGLGNGGTNFDAKTRRNSTDPEDIFIAHIAGMDAMARALESAANLLNESPYQKMLSDRYASFDAGKGKEFEEGKLSLEELVAYAKANGEPKQTSGQQELYEALVNIYSL

SEQ ID NO: 193 - protein, 440 aa, Enterobacter sakazakii
MPTYFDQLERVRYEGPKTTNLLAFRHYNPDELVAGKRMEDHLRFAACYWHTFCWNGSDMFGVGAFERPWQQAGDALSLAKRKADVAFEFFHKLNVPYYCFHDVDVSPEGASLKEYLNNFAQMVEVLAQKQQESGVKLLWGTANCFTHPRYGAGAATNPDPEVFSWAATQVVTAMNATHQLGGENYVLWGGREGYETLLNTDLRQEREQLGRFMQMVVEHKHKTGFRGTLLIEPKPQEPTKHQYDYDAATVYGFLKQFGLEKEIKLNIEANHATLAGHSFHHEIASAIALGLFGSVDANRGDPQLGWDTDQFPNSVEENALVMYEILKAGGFTTGGLNFDAKVRRQSTDKYDLFYGHIGAMDTMALSLKVAAKMLEEGELDKRVARRYAGWNGELGQQILKGQMTLAELAQYAEQHNLAPQHQSGHQEQLENLVNYYLFDK

SEQ ID NO: 194 - protein, 435 aa, Brucella abortus; identical to SEQ ID NO: 170

SEQ ID NO: 195 - protein, 445 aa, Geobacillus thermodenitrificans
MAYFPNIGKIAYEGPESRNPFAFKFYNPEEKVGGKTMEEHLRFSVAYWHTFTGDGSDPFGVGNMIRPWDKYSGMDLAKARVEAAFELFEKLNVPFFCFHDVDIAPEGETLSETYKNLDEIVDMIEEYMKTSKTKLLWNTANLFSHPRFVHGAATSCNADVFAYAAAKVKKGLEIAKRLGAENYVFWGGREGYETLLNTDMKLELDNLARFFHMAVDYAKEIGFDGQFLIEPKPKEPTKHQYDFDVATALAFLQTYGLKDYFKFNIEANHATLAGHTFEHELRVARIHGMLGSVDANQGDMLLGWDTDEFPTDLYATTLAMYEILQNGGLGRGGLNFDAKVRRGSFEPEDLFYAHIAGMDSFAIGLKVAHRLLEDRVFEQFIEERYKSYTEGIGREIVEGTADFHKLEQYALQLGEIRNTSGRLERLKTLLNQYLLEVSVPSKARL

SEQ ID NO: 196 - protein, 438 aa, Bacteroides thetaiotaomicron
MATKEFFPGIEKIKFEGKDSKNPMAFRYYDAEKVINGKKMKDWLRFAMAWWHTLCAEGGDQFGGGTKQFPWNGNADAIQAAKDKMDAGFEFMQKMGIEYYCFHDVDLVSEGASVEEYEANLKEIVAYAKQKQAETGIKLLWGTANVFGHARYMNGAATNPDFDVVARAAVQIKNAIDATIELGGENYVFWGGREGYMSLLNTDQKREKEHLAQMLTIARDYARARGFKGTFLIEPKPMEPTKHQYDVDTETVIGFLKAHGLDKDFKVNIEVNHATLAGHTFEHELAVAVDNGMLGSIDANRGDYQNGWDTDQFPIDNYELTQAMMQIIRNGGLGTGGTNFDAKTRRNSTDLEDIFIAHIAGMDAMARALESAAALLDESPYKKMLADRYASFDGGKGKEFEDGKLTLEDVVAYAKTKGEPKQTSGKQELYEAILNMYC

SEQ ID NO: 197 - protein, 439 aa, Haemophilus influenzae
MTTYFDKIEKISFEGEKSTNPFAFKHYDANQVILGKTMAEHLRLAVCYWHTFCWNGNDMFGLGSLERSWQKNSNLLAGAEQKADIAFEFLNKLGVPYYCFHDVDIAPEGNSVREYVQNFHHIVDILERKQVETGVKLLWGTANCFTNPRYMSGAATNPNPEVFAWAATQVFNAMNATQRLGGENYVLWGGREGYETLLNTDLKREREQIGRFMQMVVEHKHKIGFKGTLLIEPKPQEPTKHQYDYDVATVYGFLKQFGLEKEIKVNIEANHATLAGHTFQHEIATACALDIFGSIDANRGDPQLGWDTDQFPNSVEENTLVMYEILKHGGFTTGGFNFDAKIRRQSIDPYDLFYAHIGAIDVLALSLKRAAKMLQEETLQKIVNERYAGWNSELGQHILQGKTSLETLAQLVQQKDLAPKPVSGQQEYLENLVNQVIYS

SEQ ID NO: 198 - protein, 439 aa, Yersinia pseudotuberculosis; identical to SEQ ID NO: 173

SEQ ID NO: 199 - protein, 446 aa, Xanthomonas campestris
MSNTVFIGAKEYFPGIGKIGFEGRDSDNPLAFKVYDANKQVAGKSMAEHLRFAVAYWHSFCGNGADPFGPGTRAYPWDVGNTALARAEAKSDAAFEFFTKLGVPYYCFHDIDLAPDADDIGEYENNLKHMVRIAKQRQADTGVKLLWGTANLFSHPRYMNGASTNPDFNVVARAAVQVKAAIDATVELGGENYVFWGGREGYACLHNTQMKREQDNMARFLTLARDYGRAIGFTGNFLIEPKPMEPMKHQYDFDSATVIGFLHQHGLDQDFKLNIEANHATLSGHSFEHDLQVASDAGLLGSIDANRGNPQNGWDTDQFPTDLYDTVGAMLVVLRQGGLAPGGLNFDAKVRRESSDPQDLFLAHIGGMDAFARGLEVADALLTSSPLETWRAQRYASFDSGAGADFANGTSTLADLAKYAAGRGEPTQVSGRQEAYENLINQYLTR

SEQ ID NO: 200 - protein, 439 aa, Haemophilus somnus
MSNYFDKIAKVNYEGANSTNPFAFKHYNPNEVILGKTVEEHLRLAVCYWHTFCWTGNDMFGAGSLDRSWQKTGDLLVGAKQKAEIAFEFFQKLGVPYYSFHDVDIAPESNNFKEYLHNFNTIVDILEKKQSETGVKLLWGTANCFTNPRYMSGASTNPNPEVFAWAAAQVFTAMNATQRLGGENYVLWGGREGYETLLNTDLKREREQIGRFMQLVVEHKYKIGFQGTLLIEPKPQEPTKHQYDYDVATVYGFLKQFGLENEIKVNIEANHATLAGHTFQHEIATATSLGIFGSIDANRGDPQLGWDTDQFPNSVEENTLAMYEILKAGGFTTGGFNFDAKIRRQSTDPYDLFHAHIGAMDVLALSLKRAAKMIEDQTLQKVVDNRYAGWDQELGQKILSGKASLEDLAKIVETQGLDPKPVSGQQEYLENLVNSYLYR

SEQ ID NO: 201 - protein, 439 aa, Pseudoalteromonas atlantica
MAEYFKDIPKVKFEGTSSDNPLAFRHYNPEELVLGKSMKEHLRLAACYWHNFCWDGADVFGAGTFNRPWLQAGDAMQRAKEKADVAFEFFSKLNIPYYCFHDVDVSPEGNSIKEYINNFAQMTDVLEAKQEETGLKLLWGTANLFSNPRYASGAASSPNPEVFTYGATQVMHAMNATKRLGGENYVLWGGREGYETLLNTDLRQEREQLGRFMNMVVEHKHKIGFKGLLLIEPKPQEPTKHQYDYDTATVYGFLKQYGLENEFKVNIEANHATLAGHSFQHEVATAISLGLFGSIDANRGDPQLGWDTDQFPNSVEELSLVIYEILKAGGFTSGGFNFDTKLRRQSSDPQDMFIAHIGGMDHLAIGLKKAALMIENDFLGQAVSKRYAGWNGELGKGIQGGDFNLESLANLCVDKNLQPKHVSGQQELLENKVNNVLYG

SEQ ID NO: 202 - protein, 440 aa, Escherichia fergusonii
MQAYFDQLDRVRYEGPKTTNPLAFRHYNPDELVLGKRMEDHLRFAACYWHTFCWNGADMFGVGAFDRPWQQPGEALMLAKRKADVAFEFFHKLNVPFYCFHDVDVSPEGASLKEYKNNFAEMVDVLAAKQEQSGVKLLWGTANCFTNPRYGAGAATNPDPEVFSWAATQVVTAMEATKRLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKVAARMIEDGELDKRVAQRYSGWNSELGQQILKGQMSLSDLAKYAQDHNLSPVHQSGHQELLESLVNHYLFDK

SEQ ID NO: 203 - protein, 436 aa, Silicibacter sp.
MTTGFFGDVSKITFEGADSTNPLAFRHYNPDEVILGKRMEEHLRFATCYWHNFVWPGGDPFGGQTFDRPWFKDTMHAAKLKADVAFEMFTLLQSPYYCFHDADVRPEGANFAENTRNLNEIVDYFAQKQEETGVKLLWGTANLFSNARYMSGASTNPDPDVFAFSAATIKTCMDATHRLGGENYVLWGGREGYETLLNTDLAQEDQQMGRMLNMVVEYKHKIGFKGAILVEPKPQEPSKHQYDYDAATVYGFLKRHGLENEVKLNLEQGHAILAGHSFEHEIATAQALGIFGSIDMNRNDYQSGWDTDQFPNNTPEVALAYYHILKHGGFTTGGTNFDAKLRRQSIDAEDLLMAHIGGMDICARGFKAAAAMIEDGTLDQFVTDRYAGWQTDPAQDMLAGKLSLDEIAKRVEAEDINPKPRSGRQEYLENLINRFV

SEQ ID NO: 204 - protein, 440 aa, Salmonella enterica
MQAYFDQLDRVRYEGPQSTNPLAFRHYNPDELVLGKRMEDHLRFAACYWHTFCWNGADMFGVGAFNRPWQQPGEALELAKRKADVAFEFFHKLNVPFYCFHDVDVSPEGASLKEYKNNFAQMVDVLAAKQEQSGVKLLWGTANCFTNPRYGAGAATNPDPEVFSWAATQVVTAMNATHKLGGENYVLWGGREGYETLLNTDLRQEREQIGRFMQMVVEHKHKMGFQGTLLIEPKPQEPTKHQYDYDVATVYGFLKQFGLEKEIKVNIEANHATLAGHSFHHEIATAIALGIFGSVDANRGDAQLGWDTDQFPISVEENALVMYEILKAGGFTTGGLNFDAKVRRQSTDKYDLFYGHIGAMDTMALSLKIAARMVEDGELDKRVAKRYAGWNSELGQQILKGQLSLGELAQYAEQHNLAPVHQSGHQELLENLVNRYLFDK

SEQ ID NO: 205 - protein, 449 aa, Bifidobacterium adolescentis
MGLWDIDKIPYVGREKGPQEGLAFHYYDADKVVAGKKMKDWLRFGVAWWHTFDQQLVDPFGTGTAQRPWYGKYSDPEDEALAKVDYAFEFFQKLGVEYFCFHDRDIAPEGDTLRETDKNLDKVVDKIEENMKSTGIKLLWNTSSLFTNPRFVSGASTSPFADIYAYAGGQLKHSLEIAKRLGAENYVFWGGREGYENLWNTQMKREQEHMAKFFHMCHDYAKEIGLDAQFLIEPKAKEPTMFQYDFDAATAINFLRTYDLMDVFKLNLEGNHANLAGHTYQHEIRTAREAGVLGSLDANQGDKLIGWDMDEFPTDLYETSTVMWEVLAEGQIGPHGGLNFDAKPRRTSFTAEDLFRSHIAGMDSFAAGLLVAAKMHEDKVIENLQAERYSSFDSGIGATVENGTASLASLEEYALDIPQSKLIEATKSDHLESVKATINNYMIDALAEA

SEQ ID NO: 206 - protein, 439 aa, Staphylococcus xylosus
MSYFDINKVNYEGPKSNNAFSFKYYNPEEKLGNHSMSELLRFSVAYWHTFTADLSDPFGVGVAERDWDSLDEMEKAKARVEAIFEFMEKTRIDYFCFHDVDISPEGASLKESNENLDIIVELIKEKMDQTGKKLLWNTTNNFTHERFVHGAATSSNAEVFAYAAAKVKKSLEIAKKLGSENFVFWGGREGYESLLNTNMKLELDNLATFFKMAKSYADEIGYTGQFLIEPKPKEPTTHQYDTDVATAHAFLQKYDLDKDFKFNIEANHATLAGHTFQHELRYARDNNMLGSVDANQGHPLLGWDTDESTDVYDTTLAMYEILKNGGLAPGGLNFDAKPRRTSFKQEDLILTHIAGMDTFALGLRVAYKMIEDNFFENIMDEKYKSFNEGIGKKIVEGETSLKELEDYAFNINTINNTSDHLEVIKSQINQYILNINNKD

SEQ ID NO: 207 - protein, 444 aa, Thermotoga maritima
MAEFFPEIPKIQFEGKESTNPLAFRFYDPNEVIDGKPLKDHLKFSVAFWHTFVNEGRDPFGDPTAERPWNRFSDPMDKAFARVDALFEFCEKLNIEYFCFHDRDIAPEGKTLRETNKILDKVVERIKERMKDSNVKLLWGTANLFSHPRYMHGAATTCSADVFAYAAAQVKKALEITKELGGEGYVFWGGREGYETLLNTDLGLELENLARFLRMAVEYAKKIGFTGQFLIEPKPKEPTKHQYDFDVATAYAFLKNHGLDEYFKFNIEANHATLAGHTFQHELRMARILGKLGSIDANQGDLLLGWDTDQFPTNIYDTTLAMYEVIKAGGFTKGGLNFDAKVRRASYKVEDLFIGHIAGMDTFALGFKIAYKLAKDGVFDKFIEEKYRSFKEGIGKEIVEGKTDFEKLEEYIIDKEDIELPSGKQEYLESLLNSYIVKTIAELR

SEQ ID NO: 208 - protein, 440 aa, Salmonella enterica
MQAYFDQLDRVRYEGPQSTNPLAFRHYNPDELVLGKRMEDHLRFAACYWHTFCWNGADMFGVGAFNRPWQQPGEALELAKRKADVAFEFLHKLNVPFYCFHDVDVSPEGASLKEYKNNFAQMVDVLAAKQEQSGVKLLWGTANCFTNPRYGAGAATNPDPEVFSWAATQVVTAMNATHKLGGENYVLWGGREGYETLLNTDLRQEREQIGRFMQMVVEHKHKMGFQGTLLIEPKPQEPTKHQYDYDVATVYGFLKQFGLEKEIKVNIEANHATLAGHSFHHEIATAIALGIFGSVDANRGDAQLGWDTDQFPISVEENALVMYEILKAGGFTTGGLNFDAKVRRQSTDKYDLFYGHIGAMDTMALSLKIAARMVEDGELDKRVAKRYAGWNGELGQQILKGQLSLGELAQYAEQHNLAPVHQSGHQELLENLVNRYLFDK

SEQ ID NO: 209 - protein, 438 aa, Pseudomonas syringae
MPYFPAVDKVRYEGPDSDSPLAFRHYDADKLILGKPMREHLRMAACYWHTFVWPGADMFGVGTFKRPWQGSGDPLELAIGKAETAFEFFSKLGIDYYSFHDTDVAPEGSSLKEYRNNFAQMIDQLERHQEQTGIKLLWGTANCFSNPRFAAGAASNPDPEVFAYAATQVFSAMNATQRLKGANYVLWGGREGYETLLNTDLRQEREQLGRFMRMVVEHKHKIGFKGDLLIEPKPQEPTKHQYDYDSATVFGFLQQYGLEKEIKVNIEANHATLAGHSFHHEIATAVSLGIFGSIDANRGDPQNGWDTDQFPNSVEEMTLATYEILKAGGFTNGGYNFDSKVRRQSLDEVDLFHGHVAAMDVLALALERAAAMVQNDKLQQFKDQRYAGWQQPFGKSLLAGEFSLESLAKHAFDKDLNPQAVSGRQELLEGVVNRFIYF

SEQ ID NO: 210 - protein, 425 aa, Shigella boydii
MQAYFDQLDRVRYEGSKSSNPLAFRHYNPDELVLGKRMEEHLRFAACYWHTFCWNGADMFGVGAFNRPWQQPGEALALAKRKADVAFEFFHKLHVSFYCFHDVDVSPEGASLKEYINNFAQMVDVLAAKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAARMIEDGELDKRIAQRYSGWNSELGQQILKGQMSLADLAKYAQEHNLSPVHQSGR

SEQ ID NO: 211 - protein, 440 aa, Burkholderia ambifaria
MSYFEHIPAIRYEGPQSDNPLAYHHYDAEKRVLGKTMAEHLRIAVCYWHTFVWPGHDIFGQGAFQRPWQQPGDALERARLKADAAFEFFTKLGTPFYTFHDTDVAPEGDSLREYAANFARMVDYLGERQQASGVRLLWGTANLFSHPRFAAGAATNPNPDVFAWAATQVCHALDATHRLGGENYVLWGGREGYETLLNTDLKRERDQFARFLSMVVEHKHRIGFKGALLIEPKPQEPTKHQYDYDVATVHGFLVQYGLQNEIRVNIEANHATLAGHSFHHEIANAFALGVFGSVDANRGDPQNGWDTDQFPNSVEELTLAFYEILRHGGFTTGGMNFDAKVRRQSVDPEDLFYGHVGAIDVLALALERAAVLVENDRLDALRRQRYAQWDDAFGQKILSGGYTLQSLADDALARGVDPRHASGAQERLENIVNQAIYGLR

SEQ ID NO: 212 - protein, 445 aa, Bacillus amyloliquefaciens
MAHSHSGSVNYFESANKVIYEGKESTNPLAFKYYNSQEVIGGKTMKEHLRFSIAYWHTFTADGTDIFGAATMQRPWDHYKGMDLARARVDAAFELFEKLDAPFFAFHDRDIAPEGSTLKETNQNLDLIVDMIKDYMRTSGVKLLWNTANMFTNPRFVHGAATSCNADVFAYAAAQVKKGLETAKELGAENYVFWGGREGYETLLNTDLKFELDNMARFMHMAVDYAKEIGYTGQFLIEPKPKEPTTHQYDTDAATTIAFLKQYGLDNHFKLNLEANHATLAGHTFEHELRMARVHGLLGSVDANQGDPLLGWDTDEFPTDLYSATLAMYEILKNGGLGSGGLNFDAKVRRSSFEPDDLLYAHVAGMDTFARGLKAARKLIEDRVFEDVIQHRYRSFTEGIGLEIAEGRADFKTLEQYALNNQPIKNESGRQERLKAILNQYILQV

SEQ ID NO: 213 - protein, 439 aa, Haemophilus influenzae
MTSYFDKIEKISFEGEKSTNPFAFKHYDANQVILGKTMAEHLRLAVCYWHTFCWNGNDMFGLGSLERSWQKNPNLLAGAEQKADIAFEFLNKLGVPYYCFHDVDIAPEGNSVREYVQNFHHIVDILERKQVETGIQLLWGTANCFTNPRYMSGAATNPNPEVFAWAATQVFNAMNATQRLGGENYVLWGGREGYETLLNTDLKREREQIGRFMQMVVEHKHKIGFKGTLLIEPKPQEPTKHQYDYDVATVYGFLKQFGLEKEIKVNIEANHATLAGHTFQHEIATACALDIFGSIDANRGDPQLGWDTDQFPNSVEENTLVMYEILKHGGFTTGGFNFDAKIRRQSIDPYDLFYAHIGAIDVLALSLKRAAKMLQEETLQKIVNERYAGWNSELGQHILQGKTSLETLAQLVQQKDLAPKPVSGQQEYLENLVNQVIYS

SEQ ID NO: 214 - protein, 445 aa, Bacillus megaterium
MVQTSTNKINHFESANKVLYEGKDSKNPLAFKYYNPEEVVGGKTMKDQLRFSVAYWHQFTADGTDPFGAATMQRSWDRYDGMDLAKARVEAAFQLFETLNVPFFAFHDRDIAPEGSTLQETNKNLDVIVTMIKEYMQTSNVKLLWNTANMFTNPRFVHGAATSCNADVFRYAAAQVKKGLETAKELGAENYVFWGGREGYETLLNTNLQLELDNLARFMHMAVDYATEIGYTGQFLIEPKPKEPTTHQYDTDAATTISFLRQYGLDKYFKLNLEANHATLAGHTFEHELRVARVQGLLGSVDANQGDPLLGWDTDEFPTDLYSTTLAMYEILQNGGLGSGGLNFDAKVRRGSFEQDDLLYAHVAGMDAFARGLKVAHKLVEDRVFENVINERYSSFKEGIGLEIVEGKANFHTLEQYAFKNPNIANKSGRQERLKSILNQYILEV

SEQ ID NO: 215 - protein, 477 aa, Arabidopsis thaliana
MKKVEFFMLLLCFIAASSLVSADPPTCPADLGGKCSDSDDWQGDFFPEIPKIKYEGPSSKNPLAYRWYNAEEEILGKKMKDWFRFSVAFWHTFRGTGGDPFGAATKYWPWEDGTNSVSMAKRRMRANFEFLKKLGVDWWCFHDRDIAPDGTTLEESNKNLDEVIELAKELQKGSKIKPLWGTAQLFLHPRYMHGGATSSEVGVYAYAAAQVKKAMEVTHYLGGENYVFWGGREGYQTLLNTDMGRELDHLARFFEAAVAYKKKIGFKGTLLIEPKPQEPTKHQYDWDAATAANFLRKYGLIDEFKLNIECNHATLSGHTCHHELETARINGLLGNIDANTGDAQTGWDTDQFLTDVGEATMVMMSVIKNGGIAPGGFNFDAKLRRESTDVEDLFIAHISGMDTMARGLRNAVKILEEGSLSELVRKRYATWDSELGKQIEEGKADFEYLEKKAKEFGEPKVSSAKQELAEMIFQSAM

SEQ ID NO: 216 - protein, 440 aa, Escherichia coli
MQAYFDQLDRVRYEGSKSSNPLAFRHYNPDELVLGKRMEEHLRFAACYWHTFCWNGADMFGVGAFNRPWQQPGEALALAKRKADVAFEFFHKLHVPFYCFHDVDVSPEGASLKEYINNFAQMVDVLAAKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAARMIEDGELDKRIAQRYSGWNSELGQQILKGQMSLADLAKYAQEHNLSPVHQSGRQEQLENLVNHYLFDK

SEQ ID NO: 217 - protein, 439 aa, Bacteroides fragilis
MATKEYFPGIGKIKFEGKDSKNPMAFRYYDAEKMINGRSMKDWLKFAMAWWHTLCAEGGDQFGGGTKQFPWNGDPDPVQAAKNKMDAGFEFMQKMGIGYYCFHDVDLVTEADSIEAYEANLKELVAYAKQKQAETGIKLLWGTANVFSHARYMNGAATNPDFDVVARAAVQIKNAIDATIELGGTNYVFWGGREGYMSLLNTDQKREKEHLAQMLTIARDYGRARGFKGTFLIEPKPMEPTKHQYDVDTETVIGFLKAHGLNQDFKVNIEVNHATLAGHTFEHELAVAVDNGMLGSIDANRGDYQNGWDTDQFPIDNFELTQAMMQIIRNDGLGNGGTNFDAKTRRNSTDPEDIFIAHIAGMDAMARALESAANLLNESPYQKMLSDRYASFDAGKGKEFEEGKLSLEELVAYAKANGEPKQTSGQQELYEALVNIYSL

SEQ ID NO: 218 - protein, 438 aa, Pseudomonas fluorescens
MPYFPDIERIRYEGPASDSPLAFRHYDADKIILGKPMREHLRMAACYWHTFVWPGSDVFGAGTFKRPWQHAGDPMELAIGKAQAAFEFFSKLGIDYYCFHDTDVAPEGNSLKEYRNHFAQMIDHLERHQEESGIKLLWGTANCFSNPRFAAGAASNPDPEVFACAAAQVFSAMNATQRLKGANYVLWGGREGYETLLNTDLKREREQLGRFMRMVVEHKYKIGFKGDLLIEPKPQEPTKHQYDYDSATVFGFLQQFGLEKEIKVNIEANHATLAGHSFHHEVATAVSLGIFGSIDANRGDPQNGWDTDQFPNSVEEMTLVTYEILKAGGFGNGGFNFDSKVRRQSLDETDLFHGHVGAMDVLALSLERAAAMVQNDQLQRLKDQRYAGWQQPFGQSVLAGDFNLQSLAEHAFANELNPQAVSGRQEMLENVVNRFIYR

SEQ ID NO: 219 - protein, 440 aa, Escherichia coli
MQAYFDQLDRVRYEGSKSSNPLAFRHYNPDELVLGKRMEEHLRFAACYWHTFCWNGADMFGVGAFNRPWQQPGEALALAKRKADVAFEFFHKLHVPFYCFHDVDVSPEGASLKEYINNFAQMVDVLAGKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAARMIEDGELDKRIAQRYSGWNSELGQQILKGQMSLADLAKYAQEHHLSPVHQSGRQEQLENLVNHYLFDK

SEQ ID NO: 220 - protein, 445 aa, Bacillus subtilis
MAQSHSSSINYFGSANKVVYEGKDSTNPLAFKYYNPQEVIGGKTLKEHLRFSIAYWHTFTADGTDVFGAATMQRPWDHYKGMDLAKMRVEAAFEMFEKLDAPFFAFHDRDIAPEGSTLKETNQNLDMIMGMIKDYMRNSGVKLLWNTANMFTNPRFVHGAATSCNADVFAYAAAQVKKGLETAKELGAENYVFWGGREGYETLLNTDLKFELDDLARFMHMAVDYAKEIGYTGQFLIEPKPKEPTAHQYDTDAATTIAFLKQYGLDNHFKLNLEANHATLAGHTFEHELRMARVHGLLGSVDANQGHPLLGWDTDEFPTDLYSTTLAMYEILQNGGLGSGGLNFDAKVRRSSFEPDDLIYAHIAGMDAFARGLKVAHKLIEDRVFEDVIQHRYRSFTEGIGLEIIEGRANFHTLEQYALNHKSIKNESGRQEKLKAILNQYILEV

SEQ ID NO: 221 - protein, 446 aa, Xanthomonas campestris
MSNTVFIGAKEYFPGIGKIGFEGRDSDNPLAFKVYDANKQVAGKTMAEHLRFAVAYWHSFCGNGADPFGPGTRAYPWDVGNTALARAEAKSDAAFEFFTKLGVPYYCFHDIDLAPDADDIGEYENNLKHMVGIAKQRQADTGVKLLWGTANLFSHPRYMNGASTNPDFNVVARAAVQVKAAIDATVELGGENYVFWGGREGYACLHNTQMKREQDNMARFLTLARDYGRAIGFKGNFLIEPKPMEPMKHQYDFDSATVIGFLRQHGLDQDFKLNIEANHATLSGHSFEHDLQVASDAGLLGSIDANRGNPQNGWDTDQFPTDLYDTVGAMLVVLRQGGLAPGGLNFDAKVRRESSDPQDLFLAHIGGMDAFARGLEVADALLTSSPLETWRAQRYASFDSGAGADFANGTSTLADLATYAAGKGEPTQLSGRQEAYENLINQYLTR

SEQ ID NO: 222 - protein, 438 aa, Pseudomonas syringae
MPYFPDVDRVRYEGPDSDSPLAFRHYDADKLVLGKPMREHLRMAACYWHTFVWPGADMFGVGTFKRPWQGSGDPMELAIGKAEAAFEFFSKLGIDYYSFHDTDVAPEGASLKEYRHNFAHMVDHLERHQQQSGIKLLWGTANCFSNPRFAAGAASNPDPEVFAYAATQVFSAMNATQRLKGSNYVLWGGREGYETLLNTDLKREREQLGRFMRMVVEHKHKIGFKGDLLIEPKPQEPTKHQYDYDSATVFGFLQQYGLENEIKVNIEANHATLAGHSFHHEIATAVSLGIFGSIDANRGDPQNGWDTDQFPNSVEEMTLATYEILKAGGFTNGGFNFDSKVRRQSLDDIDLFHGHVAAMDVLALALERAAAMLQNDKLQHFKDQRYAGWQQPFGQSVLAGEFSLASLAEHAFANELNPQAVSGRQELLEGVVNRFIYA

SEQ ID NO: 223 - protein, 436 aa, Sinorhizobium medicae
MSTGFFGDTAKIKYEGPESTNPLAFRHYNPDDVVLGKRMEDHLRFAVAYWHSFVWPGGDPFGGQTFERPWFKDSMEAAKLKADVAFEFFQLLGAPFYCFHDADVRPEGRNFAENTRNLNDIVDYFAKKQDESGVKLLWGTANLFSNRRFMAGAATNPDPDVFAFAAATVKTCIDATQRLGGENYVLWGGREGYETLLNTDLKRELDQLGRFLNLVVEYKHKIGFKGTILIEPKPQEPTKHQYDYDVATVYGFLKKYGLENEVKLNIEQGHAILAGHSFEHELALANALGVFGSIDMNRNDYQSGWDTDQFPNNVPEMALAYYHVLAGGGFKTGGTNFDAKLRRQSIDPEDLLIGHIGGMDCCARGLKAAAKMIEDKALSAPLEERYAGWNELEAQKMLQGGFSLEEIEARVLKADVNPQPKSGRQELLENVVNRYV

SEQ ID NO: 224 - protein, 435 aa, Ochrobactrum anthropi
MSTGFFGDIQKVKYEGPDSDSPLAFRHYNPDEIVLGKRMEDHLRFAVAYWHSFAWEGGDPFGGRTFDRPWYSNELDAAKLKADVAFEFFSLLGAPYYCFHDADVRPEGRNFAENTRYLNEIVDIFEKKQAETGVKLLWGTANLFSNRRYMGGAATNPDPDVFAFAAATVKSCIDATKRLGGENYVLWGGREGYETLLNTDLGRELDQMGRFLNLVVEYKHKIGFKGTILIEPKPQEPTKHQYDYDVATVYGFLKRYGLESEVKVNIEQGHAILAGHSFEHELALARALGIFGSIDMNRNDYQSGWDTDQFPNNVPEMALAYYQVLLAGGFTTGGTNFDAKLRRQSLDPQDLLIGHIGGMDCCARGLKAAAAMLEDGALSKPLDERYAGWNGDFGKKLLTGLSLDQITAEVETKDINPQPKSGRQEYLENVVNRYV

SEQ ID NO: 225 - protein, 440 aa, Burkholderia thailandensis
MSYFEHIPAIRYEGPQSDNPLAYRHYDRTKRVLGKTLEEHLRIAVCYWHTFVWPGQDVFGQGALRRPWQQPGEPLERARQKADAAFAFFTKLGTPFYTFHDTDVAPEGANLHEYVENFARMVDYLGEHQQASGVRLLWGTANLFSHPRFAAGAATSPNPDAFAWAATQVCHALDATHRLGGENYVLWGGREGYETLLNTDLAREREQLARFLAMVVEHKHRIGFTGALLIEPKPQEPTKHQYDYDVATVHGLLTQYGLQNEIRVNIEANHATLAGHSFHHEIANAFALGVFGSVDANRGDPQNGWDTDQFPNSVEELTLAFYEILRHGGFTTGGMNFDAKVRRQSVDPEDLFHGHIGAIDVLALALERAAVLVENDRLDALRRRRYAQWDSEFGRKILAGGYSLQSLAADALARGVNPQHASGAQERLENIVNQAIYALR

SEQ ID NO: 226 - protein, 440 aa, Salmonella enterica; identical to SEQ ID NO: 148

SEQ ID NO: 227 - protein, 444 aa, Thermotoga sp.
MMEFFPEIPKIQFEGKESTNPLAFKFYDPNEVIDGKPLKDHLKFSVAFWHTFVNEGRDPFGDPTAERPWNRFSDPMDKAFARVDALFEFCEKLNIEYFCFHDRDIAPEGKTLRETNKILDKVVERIKERMKDSNVKLLWGTANLFSHPRYMHGAATTCSADVFAYAAAQVKKALEITKELGGEGYVFWGGREGYETLLNTDLGLELENLARFLRMAVEYAKKIGFTGQFLIEPKPKEPTKHQYDFDVATAYAFLKNHGLDEYFKFNIEANHATLAGHTFQHELRMARILGKLGSIDANQGDLLLGWDTDQFPTNIYDTTLAMYEVIKAGGFTKGGLNFDAKVRRASYKVEDLFIGHIAGMDTFALGFKIAYKLAKDGVFDKFIEEKYRSFKEGIGKEIVEGKTDFEKLEEYIIDKEDIELPSGKQEYLESLLNSYIVKTIAELR

SEQ ID NO: 228 - protein, 445 aa, Bacillus cereus
MAQSSTNKVSYFESVNKVLYEGKGSKNPLAFKYYNPEEIVGDKTMKEQLRFSIAYWHTFTADGTDPFGAATMQRAWDKYDGMDLAKARVEAAFQLFEKLNVPFFAFHDRDIAPEGSTLRETNKNLDVIVTMIKDYMKTSNVKLLWNTANMFTNPRFVHGAATSCNADVFAYAAAQVKKGLETAKELGAENYVFWGGREGYDTLLNTNLKLELDNLARFMQMSVDYAKEIGYTGQFLIEPKPKEPTTHQYDTDAATTISFLRQYGLENHFKLNLEANHATLAGHTFEHELRVARVQGFLGSVDANQGNPLLGWDTDEFPTNLYSTTLAMYEILQNGGLGSGGLNFDAKVRRASFEEEDLVYAHIAGMDAFARGLKVAHKLLEDRVFENIIDERYHSFRDGIGLEIVEGRANFHTLEQYALQNSIIKNQSGKQERLKAILNQYILEV

SEQ ID NO: 229 - protein, 440 aa, Salmonella enterica; identical to SEQ ID NO: 148

SEQ ID NO: 230 - protein, 440 aa, Salmonella enterica
MQAYFDQLDRVRYEGPQSTNPLAFRHYNPDELVLGKRMEDHLRFAACYWHTFCWNGADMFGVGAFNRPWQQPGEALELAKRKADVAFEFFHKLNVPFYCFHDVDVSPKGASLKEYKNNFAQMVDVLAAKQEQSGVKLLWGTANCFTNPRYGAGAATNPDPEVFSCAATQVVTAMNATHKLGGENYVLWGGREGYETLLNTDLRQEREQIGRFMQMVVEHKHKMGFQGTLLIEPKPQEPTKHQYDYDVATVYGFLKQFGLEKEIKVNIEANHATLAGHSFHHEIATAIALGIFGSVDANRGDAQLGWDTDQFPISVEENALVMYEILKAGGFTTGGLNFDAKVRRQSTDKYDLFYGHIGAMDTMALSLKIAARMVEDGELDKRVAKRYAGWNGELGQQILKGQLSLGELAQYAEQHHLAPVHQSGHQELLENLVNRYLFDK

SEQ ID NO: 231 - protein, 435 aa, Enterococcus faecalis
MVYFPKIEKIKYEGTNTKNMYAFRHYNSEEIIMGKTMKEHLRFAVAYWHTMTQDGSDPFGKAVNKRSWLGESPMETAKKRVIAFFEILEKLDVEYFCFHDIDIAPEGNSLKEFFSNIDEITDLIKEKMDETGIKLLWNTANMFSNPRYVNGAASTNNANVYAIAAAQVKKGLDVSKKLGGENYVFWGGREGYETLLNTDMKFEQDNIARLFKMAIFYGEKIGHKPQFLIEPKPKEPSKHQYDFDAATTMAFILKYGLEKDFKLNLEANHATLAGHTFEHELNVARNYGALGSIDANQGDVLLGWDTDEFPTNVYDVTLAMYEILENGGIEPGGINFDSKVRRSSFEMEDLLLAHIAGMDTFARGLKSAMKLKEDRFFEDLKEQRYSSFKKGIGAKIISGKENLESLTNYALKNDEPIIESSHIEYVKNILNDYLY

SEQ ID NO: 232 - protein, 444 aa, Thermotoga neapolitana
MAEFFPEIPKVQFEGKESTNPLAFKFYDPEEIIDGKPLKDHLKFSVAFWHTFVNEGRDPFGDPTADRPWNRYTDPMDKAFARVDALFEFCEKLNIEYFCFHDRDIAPEGKTLRETNKILDKVVERIKERMKDSNVKLLWGTANLFSHPRYMHGAATTCSADVFAYAAAQVKKALEITKELGGEGYVFWGGREGYETLLNTDLGFELENLARFLRMAVDYAKRIGFTGQFLIEPKPKEPTKHQYDFDVATAYAFLKSHGLDEYFKFNIEANHATLAGHTFQHELRMARILGKLGSIDANQGDLLLGWDTDQFPTNVYDTTLAMYEVIKAGGFTKGGLNFDAKVRRASYKVEDLFIGHIAGMDTFALGFKVAYKLVKDGVLDKFIEEKYRSFREGIGRDIVEGKVDFEKLEEYIIDKETIELPSGKQEYLESLINSYIVKTILELR

SEQ ID NO: 233 - protein, 440 aa, Escherichia coli; identical to SEQ ID NO: 160

SEQ ID NO: 234 - protein, 439 aa, Photorhabdus luminescens
MHRYFERVNRISYEGRQSNNPLAFRHYNPEEIILGKKMKDHLRFAVCYWHNFCWDGTDMFGSGAFERFWQKGGDALELAKLKADVAFEFFYKLNIPFYCFHDIDVAPEGCSLKEYIYNLGVMSDILADKQAETGVKLLWGTANCFTHPRYAAGASTNPDLNIFAYASAQVCQVMQMTKKLGGENYVLWGGREGYESLLNTDLRQEREQIGRFMQMVVDYKYKIGFQGTLLIEPKPQEPTKHQYDYDVATVYGFLKQFGLENEIKVNIEANHATLAGHSFQHEVATAIALGILGSIDANRGDAQLGWDTDQFPNSVEENSLVMYEILKAGGFTTGGLNFDAKVRRQSIDIDDLFYGHIGAIDTMALSLKSAVKILVDGKLDEYVAQRYSGWNSELGRDILEGKMTLDEVAHYAETLVQEPKHRSGQQELLENLINRYIYD

SEQ ID NO: 235 - protein, 440 aa, Enterobacter sp.
MQAYFDQLDRVRYEGPKSTNPLAFRHYNPDELVLGKRMEDHLRFAACYWHTFCWNGADMFGVGSFDRPWQQPGEALELAKRKADVAFEFFHKLNVPYYCFHDVDVSPEGASLKEYLNNFAQMVDYLGEKQQQSGVKLLWGTANCFTNPRYGAGAATNPDPEVFSWAATQVVTAMNATHKLGGENYVLWGGREGYETLLNTDLRQEREQIGRFMQMVVEHKHKIGFRGTLLIEPKPQEPTKHQYDYDVATVYGFLKQFGLEKEIKVNIEANHATLAGHSFHHEIASAIALGIFGSVDANRGDPQLGWDTDQFPISVEENALVMYEIIKAGGFTTGGLNFDAKVRRQSTDKYDLFYGHIGAMDTMALALKVAARMIEDGELDKRVAKRYAGWNSELGQQILKGQLSLAEIAKYAEQHSLAPSHQSGHQELLENLVNHYLFDK

SEQ ID NO: 236 - protein, 440 aa, Burkholderia cenocepacia
MSYFEHIPAIRYEGPQSDNPLAYHHYDPDKRVLGKTLAEHLRIAVCYWHTFVWPGHDIFGQGAFQRPWQQPGDALERARQKADAAFEFFTKLGTPFYTFHDTDVAPEGDSLRDYAANFARMVDYLGERQHASGVRLLWGTANLFSHPRFAAGAATNPNPDVFAWAATQVCHALDATHRLGGENYVLWGGREGYETLLNTDLKRERDQFARFLSMVVEHKHRIGFKGALLIEPKPQEPTKHQYDYDVATVHGFLVQYGLQNEIRVNIEANHATLAGHSFHHEIANAFALGVFGSVDANRGDPQNGWDTDQFPNSVEELTLAFYEILRHGGFTTGGMNFDAKVRRQSIDPEDLFYGHVGAIDVLALALERAAVLVENDRLDALRRQRYAQWDDAFGRKILSGGYTLESLAADALARGVNPRHASGAQERLENIVNQAIYGLR

SEQ ID NO: 237 - protein, 448 aa, Bacillus licheniformis
MFFRNIGMIEYEGADSENPYAFKYYNPDEFVGGKTMKEHLRFAVAYWHTFDADGKDPFGDGTMFRAWNRLTHPLDKAKARAEAAFEFFEKLGVPYFCFHDVDIVDEGATLRETFTYLDQMSSFLKEMMETSHVQLLWNTANMFTHPRYVHGAATSCNADVYAYAAAKVKKGLDIAKELGAENYVFWGGREGYETLLNTDMKLELENLSSFYRMAVEYAREIGFDGQFLIEPKPKEPTKHQYDFDAATTIAFLETYGLKDHFKLNLEANHATLAGHTFEHELRVAALHDMLGSIDANQGDLLLGWDTDEFPTDLYSAVLAMYEILKAGGFKTGGINFDAKVRRPSFADEDLFHAHIAGMDTYAVGLKVASRLLEDKALDQVIEERYESYTKGIGLEIKEGRTDLKKLAAYALENDHIENQSGRQERLKATVNRYLLNALREAPAGKETH

SEQ ID NO: 238 - protein, 441 aa, Geobacillus stearothermophilus
MPYFDNISTIAYEGPASKNPLAFKFYNPEEKVGDKTMEEHLRFSVAYWHTFTGDGSDPFGAGNMIRPWNKYSGMDLAKARVEAAFEFFEKLNIPFFCFHDVDIAPEGETLKETYKNLDIIVDMIEEYMKTSKTKLLWNTANLFTHPRFVHGAATSCNADVFAYAAAKVKKGLEIAKRLGAENYVFWGGREGYETLLNTDMKLELDNLARFLHMAVDYAKEIGFDGQFLIEPKPKEPTKHQYDFDVATALAFLQTYGLKDYFKFNIEANHATLAGHTFEHELRVARIHGMLGSVDANQGDMLLGWDTDEFPTDLYSTTLAMYEILKNGGLGRGGLNFDAKVRRGSFEPEDLFYAHIAGMDSFAVGLKVAHRLIEDRVFDEFIEERYKSYTEGIGREIVEGTADFHKLEAHALQLGEIQNQSGRQERLKTLLNQYLLEVCAAR

SEQ ID NO: 239 - protein, 435 aa, Brucella abortus; identical to SEQ ID NO: 170

SEQ ID NO: 240 - protein, 436 aa, Rhizobium leguminosarum
MSTGFFGDIQKVKYEGPDSTNPLAFRHYQPDEIVMGKRMEDHLRFAVAYWHTFTWPGGDPFGGQTFLRPWFEDTMKAAKLKADVAFEFFSLLGSPYYCFHDADVRPEGKTFAENTKNLNEIVDYFAEKQAATGTKLLWGTANLFSHRRYMSGAATNPDPDVFAFAAATVKTCIDATQKLGGENYVLWGGREGYETLLNTDIGRELDQLGRFLNLVVEYKHKIGYKGTILIEPKPQEPTKHQYDYDVATVYGFLKKHGLENEVKLNIEQGHAILAGHSFEHELALANALGIFGSIDMNRNDYQSGWDTDQFPNNVPEMALAYYHVLAGGGFKTGGTNFDSKLRRQSLDPADLLIGHIGGMDCCARGLKAAAKMIEDKALSQPLADRYAGWESAEAQKLFRGEYSLDEITHYVESHDVNPQPRSGKQELLENVVNRYV

SEQ ID NO: 241 - protein, 439 aa, Yersinia enterocolitica
MQSYFDELEQVRYEGSQNTNPLAFHHYNPDEIILGKRMADHLRFAACYWHTFCWGGADMFGSNAFERPWQQSGDALALAKRKADVAFEFFHKLNVPYYCFHDVDVSPEGASLKEYLNNFAVMTDVLAEKQASSGVKLLWGTANCFTHPRYGAGAATNPDPEVFSWAATQVFTAMNATQKLGGENYVLWGGREGYETLLNTDLRQEREQIGRFMQMVVEHKHKTGFQGTLLIEPKPQEPTKHQYDYDVATVYGFLKQFGLEKEIKVNIEANHATLAGHSFHHEIASAIALGIFGSVDANRGDPQLGWDTDQFPNSVEENALVMFEILKAGGFTTGGLNFDAKVRRQSTDKYDLFYGHIGAMDTMALALKIAAKMIEDGQLDKQVAERYAGWSSDLGQQILKGKMSLEDLASYAEQHNLNPHHQSGHQELLENRVNRYIFG

SEQ ID NO: 242 - protein, 439 aa, Serratia proteamaculans
MQSYFDQLEQVHYEGPTSNNPLAFHHYNPDELVLGKRMAEHLRFAACYWHTFCWNGADMFGVGSFDRPWQQPGDALTLAKRKADVAFEFFHKLNVPYYCFHDVDVSPEGASLKEYLHNFAVMTDVLEEKQHSSGVKLLWGTANCFTHPRYGAGAATNPDPEVFSWAATQVFTAMNATQRLGGENYVLWGGREGYETLLNTDLRQEREQIGRFMQMVVEHKHKTGFQGTLLIEPKPQEPTKHQYDYDVATVYGFLKQFGLEKEIKVNIEANHATLAGHSFHHEIATAIALGIFGSVDANRGDPQLGWDTDQFPISVEENALVMFEILKAGGFTTGGLNFDAKVRRQSTDKYDLFYGHIGAMDTMALALKVAAKMVTDGQLHQQVSKRYAGWNGELGQQILQGKLSLEALAQYAEGHALAPQHVSGRQEQLENLMNRYLFG

SEQ ID NO: 243 - protein, 439 aa, Yersinia pseudotuberculosis; identical to SEQ ID NO: 173

SEQ ID NO: 244 - protein, 440 aa, Escherichia coli
MQAYFDQLDRVRYEGSKSSNPLAFHHYNPDELVLGKRMEEHLRFAACYWHTFCWNGADMFGVGAFNRPWQQPGEALALAKRKADVAFEFFHKLHVPFYCFHDVDVSPEGASLKEYINNFAQMVDVLAGKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAARMIEDGELDKRIAQRYSGWNSELGQQILKGQMSLADLAKYAQEHNLSPVHQSGRQEQLENLVNHYLFDK

SEQ ID NO: 245 - protein, 439 aa, Yersinia pestis
MQSYFNELEQVRYEGSQSTNPLAFHHYNPDEMILGKRMADHLRFAACYWHTFCWGGADMFGANAFDRPWQQPGDALALAKRKAKVAFEFFHKLNVPYYCFHDVDVSPEGASLQEYLNNFAVMTDVLAEKQAASGVKLLWGTANCFTHPRYGAGAATNPDPEVFSWAATQVFTAMNATRQLGGENYVLWGGREGYETLLNTDLRQEREQIGRFMQMVVEHKHKTGFQGTLLIEPKPQEPTKHQYDYDVATVYGFLKQFGLEKEIKVNIEANHATLAGHSFHHEIASAIALGIFGSVDANRGDPQLGWDTDQFPNSVEENTLVMFEILKAGGFTTGGLNFDAKVRRQSTDKYDLFYGHIGAMDTMALALKFAAKMIEDGQLDQIVAKRYAGWNSELGQQILQGKMSLEELSRYASQHNLNPQHQSGHQELLENKVNRYLFG

SEQ ID NO: 246 - protein, 433 aa, Fervidobacterium gondwanense
MYFNVEKVVYEGPSSKNLLAYKFYNPEEEIAGKKMRDWFRFAVAYWHTFNSRGEDPFGSATFERPWFKKDPMDTAFAKVDALFEFCEKTGVEYFTFHDRDLAHEGLTLRESNKILDKVVEKIKEYMKSSNVKLLWGTANLFSHPRYAQGAATSPNPLVFSYAASQVKKMLDVTKELGGLGYVLWGGREGYDNLLLTDSALEEKLFARFLEMVVEYKERIGFNGVLMIEPKPKEPTKHQYDFDASTVLYFLKKHNLFEHFKLNIEANHATLAGHTFAHELRVARLNGKLGSIDANRGDLLLGWDTDQFPTDVYETTFAMYEVLENNGLDCGFNFDAKVRRASIDPEDIVYAHVSSMDAFALGLKLAVKLREKVKPMIEERYSEYNSEIGMKILEGKTTLDELSSYVEDLTDVRVKSLKQELLEMVINDVIFGGR

SEQ ID NO: 247 - protein, 446 aa, Xanthomonas campestris; identical to SEQ ID NO: 221

SEQ ID NO: 248 - protein, 436 aa, Rhizobium leguminosarum
MSTGFFGDIQKVKYEGPDSTNPLAFRYYQPDEIVMGKRMEDHLRFAVAYWHTFTWPGGDPFGGQTFLRPWFEDTMKAAKLKADVAFEFFSLLGSPYYCFHDADVRPEGKNFAENTKNLNEIVDYFAEKQASTGTKLLWGTANLFSNRRYMSGAATNPDPDVFAFAAATVKTCIDATQKLGGENYVLWGGREGYETLLNTDLKRELDQLGRFLNLVVEYKHKIGYTGTILIEPKPQEPTKHQYDYDVATVYGFLKKHGLENEVKLNIEQGHAILAGHSFEHELALANALGIFGSIDMNRNDYQSGWDTDQFPNNVPEMALAYYHVLAGGGFKTGGTNFDSKLRRQSLDPADLLIGHIGGMDCCARGLKAAARMIEDKALSQPLADRYAGWESAEAQKLFRGEYSLDEITNWVETKDVNPQPRSGKQELLENVVNRYV

SEQ ID NO: 249 - protein, 438 aa, Bradyrhizobium japonicum
MSAKFFEESTPVAFAGQDAGPAPAFRWYDKDRLVHGRRLEDHLRFAVCYWHSLCWPGGDPFGGETFLRPWHHGTDAMAQARAKADVAFELFRLLDVPFFTFHDVDAAPEGASLAESVANLNAIADLFEAKMASAKVRLLWGTANLFTHRRYMAGAATNPDPDIFTYAAGQVRAALEVTHRLGGQNYVLWGGREGYETLLNTDLKRELDQLGRFVSLVVEHKHKIGFNGPILIEPKPKEPTKHQYDFDVATCYGFLARYDLLKDVKLNIEQNHAILAGHSFHHEVALAEALGVFGSLDVNRGDDLLGWDTDQFAMNVPELALVFHEILNRGGFTSGGLNFDAKIRRQSIDPDDLIHAHVGSMDACARAFLAAADMLDAGALTAPLDKRYEGWAGPEGRAILGGQRSLADLADRALGPGFDPQPRSGRQEYLESLVNRYV

SEQ ID NO: 250 - protein, 436 aa, Mesorhizobium sp.
MSTGFFGNLQPISYEGPQSDNPLAFRHYNPDEVVLGKRLEDHLRFAVCYWHTFVWPGGDPFGGQTFERPWFGDTMERARLKADVAFELFEILGVPFFTFHDADVRPEGASYSESVARLNDIADYIAAKMEKTGVRLLWGTANLFSHRRFMAGAATNPDPDVFAYAAATVKACIDVTKRLNGENYVLWGGREGYETLLNTDLGRELDQLGRFLSMVVDYKHRIGFKGAILIEPKPQEPTKHQYDFDVGTVYGFLKRYGLEDEVKVNIEQGHALLAGHSFEHELALAATLGIFGSIDMNRNDYQSGWDTDQFPNNAPEAALAYYYILQAGGFTTGGTNFDAKLRRQSLDPEDLVAAHIGGMDICAQGLKAAARMIEDKALSGPLEERYSGWNATEAQAMLKGERSLEAIAERVARENLDPKPRSGRQEKLENIINRYV

SEQ ID NO: 251 - protein, 439 aa, Actinobacillus pleuropneumoniae; identical to SEQ ID NO: 167

SEQ ID NO: 252 - protein, 439 aa, Yersinia pseudotuberculosis; identical to SEQ ID NO: 173

SEQ ID NO: 253 - protein, 446 aa, Xanthomonas campestris; identical to SEQ ID NO: 199

SEQ ID NO: 254 - protein, 440 aa, Burkholderia cenocepacia
MSYFEHIPAIRYEGPQSDNPLAYHHYDPDKRVLGKTLAEHLRIAVCYWHTFVWPGHDIFGQGAFQRPWQQPGDALERARQKADAAFEFFTKLGTPFYTFHDTDVAPEGDSLRDYAANFARMVDYLGERQQASGVRLLWGTANLFSHPRFAAGAATNPNPDVFAWAATQVCHALDATHRLGGENYVLWGGREGYETLLNTDLKRERDQFARFLSMVVEHKHRIGFKGALLIEPKPQEPTKHQYDYDVATVHGFLVQYGLQNEIRVNIEANHATLAGHSFHHEIANAFALGVFGSVDANRGDPQNGWDTDQFPNSVEELTLAFYEILRHGGFTTGGMNFDAKVRRQSIDPEDLFYGHVGAIDVLALALERAAVLVENDRLDALRRQRYAQWDDAFGRKILSGGYTLESLAADALARGVNPRHASGAQERLENIVNQAIYGLR

SEQ ID NO: 255 - protein, 439 aa, Oceanobacillus iheyensis
MSYFNEIGTIQYEGAKSDNPFAFKFYNPTESINGQTMEEHLRFGVAYWHTFTEDLSDPFGNGTAIRPWDKFNGMDLAKARVEAAFEFFEKLQIPYFCFHDVDIAPEGSSLKESNENLDTVVAMIKEYMKDSKTKLLWNTVNNFTHPRFVHGAASSNNADVFAYAAAKVKKGLEVGKELGAENYVFWGGREGYETLLNTNMKLELDNLARFFHMAKDYANEIDFNAQFLIEPKPKEPTSHQYDFDVASGYAFLQNYDLQDTFKFNIEANHATLAGHTFEHELHYARIHNMLGSVDANQGHPLLGWDTDEFPSDIYTTTLAMYEILKNDGLGKGGLNFDAKVRRGSFTAEDLFHAHIAGMDSFAIGLKVAQRLMDDRVLENVVEDRYRSFNQGIGRDIVSGKTDFHQLEKHALTLSEITQPSGQLEVIKNKINQYLLTTFA

SEQ ID NO: 256 - protein, 435 aa, Brucella suis
MSTGFFGDIQKVRYEGPESDNLLAFRHYNADEIVLGKRMQDHLRFAVAYWHSFAWEGGDPFGGRTFDRPWFSNEIDAAKLKADVAFEFFSLLGAPYYCFHDADVRPEGRNFAENTRYLNEIVDIFEKKQAETGMKLLWGTANLFSNRRYMAGAATNPDPDVFAFAAATVKTCIDATKRLGGENYVLWGGREGYETLLNTDLSRELDHMGRFLSLVVEYKHKIGFKGTILIEPKPQEPTKHQYDYDVATVYGFLKRYGLENEVKVNIEQGHAILAGHSFEHELALARTLGIFGSIDMNRNDYQSGWDTDQFPNNVPEKALAYYQVLLAGGFTTGGTNFDAKLRRQSLDPQDLLIGHIGGMDCCARGLKAAARMLEDGALSKPLDERYAGWNGEFGKRLLSGLSLDQIAGEVEAKDINPQPKSGRQEYLENIVNRYV

SEQ ID NO: 257 - protein, 439 aa, Thermoanaerobacterium thermosaccharolyticum
MSKYFEKVSKIKYEGPKSNNPYAFKFYNPEEVIDGKTMEEHLRFSIAYWHTFTADGTDQFGKATMQRPWNHLTDPMDIAKARVEAAFEFFDKINAPFFCFHDRDIAPEGDTLRETNKNLDIIVAMIKDYLKTSKTKVLWGTANLFSNPRFVHGASTSCNADVFAYSAAQVKKALEITKELGGQNYVFWGGREGYETLLNTDMELELDNFARFLHMAVDYAKEIGFEGQFLIEPKPKEPTKHQYDFDVANVLAFLRKYDLDKYLKVNIEANHATLAAHDFQHELRYARINGVLGSIDANTGDMLLGWDTDQFPTDIRMTTLAMYEVIKMGGFDKGGLNFDAKVRRASFEPEDLFLGHIAGMDAFAKGFKVAYKLVKDAEFDKFIEERYASYKDGIGADIVSGKADFKSLEKYALEHSEIVTNQVDKKCLNQYSIQYLFTE

SEQ ID NO: 258 - protein, 441 aa, Burkholderia phymatum
MSYFEHLPAVRYEGPQTDNPFAYRHYDKDKLVLGKRMEDHLRVAVCYWHTFVWPGADMFGPGTFERPWHHAGDALEMAHAKADHAFELFSKLGTPFYTFHDLDVAPEGDSIKSYVNNFKAMTDVLARKQEQTGIKLLWGTANLFSHPRYAAGAATNPNPDVFAFAATQVLNALEATQRLGGANYVLWGGREGYETLLNTDLKREREQLGRFMSMVVEHKHKTGFKGALLIEPKPQEPTKHQYDYDVATVHGFLTQFGLQDEIRVNIEANHATLAGHSFHHEIANAFALGIFGSVDANRGDAQNGWDTDQFPNSVEELTLAFYEILRNGGFTTGGMNFDAKVRRQSIDPEDIVHGHIGAIDVLAVALERAAHLIEHDRLAAFKQQRYAGWDSDFGRKILAGGYSLESLASDAVQRNIAPRHVSGQQERLENIVNQAIFSSAK

SEQ ID NO: 259 - protein, 439 aa, Yersinia pseudotuberculosis; identical to SEQ ID NO: 173

SEQ ID NO: 260 - protein, 441 aa, Bacillus sp.
MPYFDNISTIAYEGPASKNPLAFKFYNPEEKVGDKTMEEHLRFSVAYWHTFTGDGSDPFGAGNMIRPWNKYSGMDLAKARVEAAFEFFEKLNIPFFCFHDVDIAPEGETLKETYKNLDIIVDMIEEYMKTSKTKLLWNTANLFTHPRFVHGAATSCNADVFAYAAAKVKKGLEIAKRLGAENYVFWGGREGYETLLNTDMKLELDNLARFLHMAVDYAKEIGFDGQFLIEPKPKEPTKHQYDFDVATALAFLQTYGLKDYFKFNIEANHATLAGHTFEHELRVARIHGMLGSVDANQGDMLLGWDTDEFPTDLYSTTLAMYEILKNGGLGRGGLNFDAKVRRGSFEPEDLFYAHIAGMDSFAVGLKVAHRLIEDRVFDEFIEERYKSYTEGIGREIVEGTVDFHKLEAHALQLGEIQNQSGRQERLKTLLNQYLLEVCAAR

SEQ ID NO: 261 - protein, 389 aa, Lactococcus lactis
MAYFNDIAPIKYEGTKTKNMFAFRHYNPEEVVAGKTMEEQLHFALAFWHTITMDGADPFGSATMERPWDLEGGSELDRAHRRVDAFFEIAEKLGVKYYCFHDIDIAPTGNSLKEFYANLDEITDHLLEKQKETGIKLLWNTANMFSNPRYMNGVSTSNRAEVFAYGAAQVKKGLELSKKLGGENYVFWGGREGYESLLNTDMGLEMDHMAKFFHLAIDYAKSINHLPIFLIELKPKEPMTHQYDFDAATALAFLQKYDLDKYFKLNIETNHAWLAGHTFEHELNTARTFGALGSIDANQGNYLLGWDTDEFPTLVIDITLQGWILMHVRLKVQQPSLKTNSCLISLKNVIVHTRRQKLVNLSKMEQQLLKVLLLMLLSMGMTSNLILTT

SEQ ID NO: 262 - protein, 437 aa, Novosphingobium aromaticivorans
MSADYFADFQTVRYEGPDSDNDFAYRWYDKDRVILGKRMEDHLRFAVCMWHTFCWPGSDVFGAGTFTRPWLQGPMDARNAAAKREAALAFVEKLDVPFYCFHDVDVMAEAEGIGEFRSSFAEAVDHLEELQGKHGRKLLWGTANLFGHPRYMAGAATNPDPEVFAWGASQVRDALEATHRLGGANYVLWGGREGYDSILNTEIGIEQENFGRFLSLVVDHKHRIGFKGTILIEPKPHEPTKHQYDFDTQTVFGFLKRFGLESEVKVNIEANHATLSGHTFEHELAMARALGILGSIDANRGDHQNGWDTDQFPNSVEELTLAMLELIRAGGFTDGGFNFDAKVRRQSIDAADLFHGHIGGIDTIAHALVKAAALIEDGKLDAFRAERYAGWQGELGRKIHADGTTLADIADIAVARDLAPVRRSGRQEWCENLINRV

SEQ ID NO: 263 - protein, 449 aa, Lactobacillus brevis
MTEEYWKGVDKIQYVGHQDKKSGLGFQYYNPEEEIMGKKMKDWLRFAVAYWHTFDQRLVDPFGDGTAQRPYDKYTDPMDLALAKVDAAFEFYQKLGVDYLCFHDRDLAPEGDTLRETNANLDKVVDKIVEYQKTSGMKVLWNTSNMFTNPRFVEGAATSPYADVFAYSAAQLKHSLEIGKRVGSENYVFWGGREGYESLWNTNMKQEQEHAAKIFHMAKDYANEIGFDAQMLLEPKPKEPTTHQYDFDAATTIAFMKEYDLDKDFKLNLEGNHANLAGHTYQHEIRVAREAGLLGSLDANQGDKLIGWDIDEYPSNLYETTAAMYEVVENGSIGPRGGLNFDAKPRRSAFAPEDLFLGHIVGMDSFAAGLRVAAAMKQDGFLDNLKADRYSSYKSGVGADIESGKADLKSLEAYAIDKPQSELIAATHSDHLEEIKDTINHYIIDTLSK

SEQ ID NO: 264 - protein, 441 aa, Mesorhizobium loti
MSSGFFGDIQKIKYEGPDSTNPLAYRFYNPDEVVAGKRLEDHLRFAVAYWHSFAWPGGDPFGGQTFDRPWFPKAGGIDTMELAKLKADVAFEMFSLLGAPYFCFHDADVRPEGKDFSESAARLDEIADYFAGKMKQTGVKLLWGTANLFSHRRFMSGAATNPDPDVFAYAAATVKSCIDVTKRLKGENYVLWGGREGYETLLNTDLAREQEQAGRFLSLVVDYKHKIGFKGTILIEPKPQEPTKHQYDYDVATVYGFLKRFGLEKEVKLNIEQGHAILAGHSFEHELALANALGVFGSIDMNRNDYQSGWDTDQFPNNVPEMALAYYQILQAGGFKTGGTNFDAKLRRQSLDPQDLLIGHIGGMDACARGLKAAARMVEDKALSAPLAERYAGWNSAEGKAMLSGKRTLEDIAERVVKKKIEPQPRSGRQELLENIVNRYV

SEQ ID NO: 265 - protein, 440 aa, Escherichia coli; identical to SEQ ID NO: 160

SEQ ID NO: 266 - protein, 440 aa, Burkholderia cenocepacia; identical to SEQ ID NO: 254

SEQ ID NO: 267 - protein, 439 aa, Thermoanaerobacterium thermosulfurigenes
MNKYFENVSKIKYEGPKSNNPYSFKFYNPEEVIDGKTMEEHLRFSIAYWHTFTADGTDQFGKATMQRPWNHYTDPMDIAKARVEAAFEFFDKINAPYFCFHDRDIAPEGDTLRETNKNLDTIVAMIKDYLKTSKTKVLWGTANLFSNPRFVHGASTSCNADVFAYSAAQVKKALEITKELGGENYVFWGGREGYETLLNTDMEFELDNFARFLHMAVDYAKEIGFEGQFLIEPKPKEPTKHQYDFDVANVLAFLRKYDLDKYFKVNIEANHATLAFHDFQHELRYARINGVLGSIDANTGDMLLGWDTDQFPTDIRMTTLAMYEVIKMGGFDKGGLNFDAKVRRASFEPEDLFLGHIAGMDAFAKGFKVAYKLVKDRVFDKFIEERYASYKDGIGADIVSGKADFRSLEKYALERSQIVNKSGRQELLESILNQYLFAE

SEQ ID NO: 268 - protein, 444 aa, Thermotoga petrophila
MMEFFPEIPKIQFEGKESTNPLAFKFYDPNEVIDGKPLKDHLKFSVAFWHTFVNEGRDPFGDPTAERPWNRFSDPMDKAFARVDALFEFCEKLNIEYFCFHDRDIAPEGKTLRETNKILDKVVERIKERMKDSNVKLLWGTANLFSHPRYMHGAATTCSADVFAYAAAQVKKALEITKELGGEGYVFWGGREGYETLLNTDLGLELENLARFLRMAVEYAKKIGFTGQFLIEPKPKEPTKHQYDFDVATAYAFLKNHGLDEYFKFNIEANHATLAGHTFQHELRMARILGKLGSIDANQGDLLLGWDTDQFPTNIYDTTLAMYEVIKAGGFTKGGLNFDAKVRRASYKVEDLFIGHIVGMDTFALGFKIAYKLVKDEVLDRFIEEKYRSFKEGIGKEIVEGKADFEKLEEYIIDKEDIELPSGKQEYLESLLNSYIVKTIAELR

SEQ ID NO: 269 - protein, 449 aa, Lactobacillus pentosus
MTNEYWQGVDQIKYIGHQDKKSGLGFQYYNPDEVIGGKKMRDWLRFSVAYWHTFDQRLVDPFGDGTAQRPYDHITDPMDLALAKVDAAFEFYHKLGVDYLCFHDRDLAPEGDTLRETNRNLDKVIDKIVDYQKQTGMKVLWNTSNMFTNPRFVAGAATSPDADVFAYAAAQLKHSLEIGKRVGAENYVFWGGREGYESLWNTNMKLEQEHAAKFFHMAKDYANEIGFDAQMLLEPKPKEPSTHQYDFDAATTIAFMKEYDLDKDFKLNLEGNHANLAGHTYQHEIRVAREANLLGSLDANQGDKLIGWDIDEFPSDLYEATAAMYEVVENGSIGPRGGLNFDAKPRRSSFAANDLFYGHIVGIDTFAAGLRVALKMKQDGFLEKLVADRYSSYQSGVGAEIEAGTADFKSLESYAIDKPQSELIAATSSDPLEEVKDTINHYIIETLSK

SEQ ID NO: 270 - protein, 439 aa, Lactococcus lactis
MAYFNDIAPIKYEGTKTKNMFAFRHYNPEEVVAGKTMEEQLHFALAFWHTITMDGSDPFGGATMERPWDLEGGSELDRAHRRVDAFFEIAEKLGVKYYCFHDIDIAPTGNSLKEFYANLDEITDHLLEKQKATGIKLLWNTANMFSNPRYMNGVSTSNRAEVFAYGAAQVKKGLELSKKLGGENYVFWGGREGYESLLNTDRGLEMDHMAKFFHLAIDYAKSINHLPIFLIEPKPKEPMTHQYDFDAATALAFLQKYDLDKYFKLNLETNHAWLVGHTFEHELNTARTFNALGSIDANQGNYLLGWDTDEFPTLVIDITLAMHQILLNGGLGKGGINFDAKVRRTSFKAEDLILAHIAGMDTYARALKGAAAIIEDKFLSDIVDERYTSYKNTEVGQSIENGTATFESLAAFALEHGDDIELDSNHLEYIKSVLNDYLV

SEQ ID NO: 271 - protein, 438 aa, Ruminococcus flavefaciens
MEFFSNIGKIQYQGPKSTDPLSFKYYNPEEVINGKTMREHLKFALSWWHTMGGDGTDMFGCGTTDKTWGQSDPAARAKAKVDAAFEIMDKLSIDYYCFHDRDLSPEYGSLKATNDQLDIVTDYIKEKQGDKFKCLWGTAKCFDHPRFMHGAGTSPSADVFAFSAAQIKKALESTVKLGGNGYVFWGGREGYETLLNTNMGLELDNMARLMKMAVEYGRSIGFKGDFYIEPKPKEPTKHQYDFDTATVLGFLRKYGLDKDFKMNIEANHATLAQHTFQHELRVARDNGVFGSIDANQGDVLLGWDTDQFPTNIYDTTMCMYEVIKAGGFTNGGLNFDAKARRGSFTPEDIFYSYIAGMDAFALGFRAALKLIEDGRIDKFVADRYASWNTGIGADIIAGKADFASLEKYALEKGEVTASLSSGRQEMLESIVNNVLFSL

SEQ ID NO: 272 - protein, 440 aa, Burkholderia phytofirmans
MSYFEHIPEIRYEGPQSDNPLAYRHYDKSKKVLGKTLEEHLRIAVCYWHTFVWPGVDIFGQGTFRRPWQQAGDAMERAQQKADSAFEFFSKLGTPYYTFHDTDVSPEGSNLKEYSENFLRITDYLARKQESTGIKLLWGTANLFSHPRYAAGAATSPDPEVFAFAATQVRHALDATQRLGGDNYVLWGGREGYDTLLNTDLVRERDQLARFLHMVVDHAHKIGFKGSLLIEPKPQEPTKHQYDYDVATVHGFLLQHGLDKEIRVNIEANHATLAGHSFHHEIATAYALGIFGSVDANRGDPQNGWDTDQFPNSVEELTLAFYEILKHGGFTTGGMNFDSKVRRQSVDPEDLFYGHIGAIDNLALAVERAAVLIENDRLDQFKRQRYSGWDAEFGRKISSGDYSLSALAEEAMARGLNPQHASGHQELMENIVNQAIYSGR

SEQ ID NO: 273 - protein, 440 aa, Salmonella enterica; identical to SEQ ID NO: 204

SEQ ID NO: 274 - protein, 449 aa, Lactobacillus brevis
MTEEYWKGVDKIQYVGHQDKKSGLGFQYYNPEEEIMGKKMKDWLRFAVAYWHTFDQRLVDPFGDGTAQRPYDKYTDPMDLALAKVDAAFEFYQKLGVDYLCFHDRDLAPEGDTLRETNANLDKVVDKIVEYQKTSGMKVLWNTSNMFTNPRFVEGAATSPYADVFAYSAAQLKHSLEIGKRVGSENYVFWGGREGYESLWNTNMKQEQEHAAKIFHMAKDYANEIGFDAQMLLEPKPKEPTTHQYDFDAATTIAFMKEYDLDKDFKLNLEGNHANLAGHTYQHEIRVAREAGLLGSLDANQGDKLIGWDIDEYPSNLYETTAAMYEVVENGSIGPRGGLNFDAKPRRSSFAPEDLFLGHIVGMDSFAAGLRVAAAMKQDGFLDSLKADRYSSYKSGVGADIESGKADLKSLEAYAIDKPQSELIAATHSDHLEEIKDTINHYIIDTLSK

SEQ ID NO: 275 - protein, 440 aa, Burkholderia ambifaria
MSYFEHIPAIRYEGPQSDNPLAYHHYDAEKRVLGKTLAEHLRIAVCYWHTFVWPGHDIFGQGAFQRPWQQPGDALERARLKADAAFEFFTKLGTPFYTFHDTDVAPEGDSLREYAANFARMVDYLGERQQASGVRLLWGTANLFSHPRFAAGAATNPNPDVFAWAAAQVCHALDATHRLGGENYVLWGGREGYETLLNTDLKRERDQFARFLSMVVEHKHRIGFKGALLIEPKPQEPTKHQYDYDVATVHGFLVQYGLQNEIRVNIEANHATLAGHSFHHEIANAFALGVFGSVDANRGDPQNGWDTDQFPNSVEELTLAFYEILRHGGFTTGGMNFDAKVRRQSVDPEDLFYGHVGAIDVLALALERAAVLVENDRLDALRRQRYAQWDDAFGQKILSGGYTLQSLAEDALARGVDPRHASGAQERLENIVNQAIYGLR

SEQ ID NO: 276 - protein, 440 aa, Salmonella enterica; identical to SEQ ID NO: 204

SEQ ID NO: 277 - protein, 440 aa, Bacillus halodurans
MTFFNDVEKVQYEGPRSTNPYAFKYYNPEEIVAGKTMAEHLRFSIAYWHTFVGDGSDPFGVGTMQRPWDQYSGMDLAKARVEAAFEFFEKLNVPYFCFHDVDVAPEGETLADTYKNLDEIVLMIKDYMKTSKTKLLWNTANMFTHPRWIHGAATSPNADVYAYAAAKVKKGLEIGKELGAENYVFWGGREGYETLLNTNMKLELDNLARFFHMAVDYAKEIGFDAQFLIEPKPKEPTKHQYDFDVATGIAFLKTHGLDEHFKFNIEANHATLAGHTFEHELHLARIHDMLGSVDANQGDTLLGWDTDEFPTDLYTTTLAMYEILKNDGLGKGGLNFDAKVRRGSFEANDLFHAHIAGMDSFAIGLKVANQLLEDRVLEDVIDNRYKSYQSGIGQKIANNDTNLKELEAYALSLGEIKHSSGQQERIKATLNQYLLRVNEY

SEQ ID NO: 278 - protein, 439 aa, Bacillus clausii
MSYFPAVNHISYEGAKSDNPFAFKFYNPDEIVSGKTMAEHLRFSIAYWHTFTEALSDPFGAGTAIRPWNAYTGMDLAKARVEAAFEFFEKINVPYFCFHDVDIAPEGSSLKETYANLDVIVAMIKDYMKDSNTKLLWNTANNFTHPRFVGGAASSNEADVFAYSAAKVKKGLEIGKELGAENYVFWGGREGYESLLNTDLKLEMDNLGRFFHMAVDYAKEIGFDGQFLIEPKPKEPTTHQYDFDVATGYAFLQHYGLQDSFKFNIEANHATLAGHTFEHELRYARIHHMLGSVDANQGDPLLGWDTDEFPTDLYSTTLAMYEILQNGGLGRGGLNFDAKVRRGSFEADDLFFAHIAGMDSFAIGLKVAQQLIDDRVLEQFVDSRYQSYKEGIGREIVLGNTDFHQLEAHALSLGEIKTRSGRVERIKAIINQYLLNAFA

SEQ ID NO: 279 - protein, 439 aa, Marinomonas sp.
MSEFFKTVPVVKYEGADSSNPFAFKHYDANKMLMGKTMAEHLRVAVCYWHTFCWQGSDVFGANTFDRPWSKAASEMEAAKLKTDAAFEFFTKLGVPYYSFHDVDVSPEGRSIKEYINNFAQMVDVLQAKQEATGIKLLWGTANAFSNPRYMSGAASNPNPEIFAYAATQVFHAMNATKALKGENYVLWGGREGYETLLNTDLKRERAQLGRFMQMVVEHKYKIGFEGTLLIEPKPAEPTKHQYDYDTATVYGFLKEFGLEKEIKVNIEANHATLAGHSFHHEIATACSLGILGSVDANQGDAQLGWDTDQFPTSVEEYTLVTYEILKSGGFKTGGYMFDTKLRRQSMDLEDLFHGHIGAMDTLALSLERAVKMIEDEKLANIVDQRYAKWNDSLGADILAGKHTLQDLAEYAEKNNIDPQPVSGRQEMLENMVNGYIFK

SEQ ID NO: 280 - protein, 439 aa, Yersinia pseudotuberculosis; identical to SEQ ID NO: 173

SEQ ID NO: 281 - protein, 439 aa, Actinobacillus pleuropneumoniae; identical to SEQ ID NO: 167

SEQ ID NO: 282 - protein, 434 aa, Silicibacter pomeroyi
MTEFFADIAPVRYEGPDSANPLAFRHYDPDEMVMGKRMEDHLRFAVAYWHSFAWEGGDPFGGQTLIRPWHPQDDMTRAKVKADAAFEMFDILGVPYFCWHDADIRPEAATFAESLRNFEEIIDHFLAKMESRRTRLLWGTANMFSHRRWMAGASTNPDPDVFAYAAATVKTCLDATQRMGGQNYVLWGGREGYETLLNTDMGRELDHMGRFLSMVVDYKHKIGFKGAILVEPKPQEPSKHQYDFDAATCIGFLRKYGLEGEVKLNLEQGHAILAGHSFEHEIAVAASEGMLGSIDMNRNDYQSGWDTDQFPNNVPEVALCYYHILRAGGFTTGGTNFDAKLRRQSLDATDLIAAHVGGMDICARGLKAAAAMIEDGGLETALRDRYAGWDSDHGQGILESDLDSLFARVLAGEIDPQPHSGRQEMLENHVNRFV

SEQ ID NO: 283 - protein, 445 aa, Xanthomonas oryzae; identical to SEQ ID NO: 157

SEQ ID NO: 284 - protein, 439 aa, Thermoanaerobacterium saccharolyticum
MNKYFENVSKIKYEGPKSNNPYSFKFYNPEEVIDGKTMEEHLRFSIAYWHTFTADGTDQFGKATMQRPWNHYTDPMDIAKRRVEAAFEFFDKINAPFFCFHDRDIAPEGDTLRETNKNLDTIVAMIKDYLKTSKTKVLWGTANLFSNPRFVHGASTSCNADVFAYSAAQVKKALEITKELGRENYVFWGGREGYETLLNTDMELELDNFARFLHMAVDYAKEIGFEGQFLIEPKPKEPTKHQYDFDVANVLAFLRKYDLDKYFKVNIEANHATLAFHDFQHELRYARINGVLGSIDANTGDMLLGWDTDQFPTDIRMTTLAMYEVIKMGGFDKGGLNFDAKVRRASFEPEDLFLGHIAGMDAFAKGFKVAYKLVKDGVFDKFIEERYASYKEGIGADIVSGKADFKSLEKYALEHSQIVNKSGRQELLESILNQYLFAE

SEQ ID NO: 285 - protein, 440 aa, Escherichia coli; identical to SEQ ID NO: 216

SEQ ID NO: 286 - protein, 440 aa, Escherichia coli; identical to SEQ ID NO: 151

SEQ ID NO: 287 - protein, 440 aa, Escherichia coli; identical to SEQ ID NO: 160

SEQ ID NO: 288 - protein, 440 aa, Escherichia coli; identical to SEQ ID NO: 216

SEQ ID NO: 289 - protein, 440 aa, Escherichia coli; identical to SEQ ID NO: 160

SEQ ID NO: 290 - protein, 436 aa, Rhizobium etli
MSTGFFGDIQKIKYEGPDSTNPLAFRYYQPDEIVLGKRMEDHLRFAVAYWHTFTWPGGDPFGGQTFLRPWFEDTMKAAKLKADVAFEFFSLLGAPYYCFHDADVRPEGKNFAENTKNLNEIVDYFAEKQAATGTKLLWGTANLFSNRRYMSGAATNPDPDVFAFAAATVKTCIDATQKLGGENYVLWGGREGYETLLNTDLKRELDQLGRFLNLVVEYKHKIGFKGTILIEPKPQEPTKHQYDYDVATVYGFLKKHGLENEVKVNIEQGHAILAGHSFEHELALANALGIFGSIDMNRNDYQSGWDTDQFPNNVPEMALAYYHVLAGGGFKTGGTNFDSKLRRQSLDPADLLIGHIGGMDCCARGLKAAAKMIEDKALSQPLADRYAGWESVEAQKLFRGEYSLDEIANWVESKDVNPQPKSGKQELLENVVNRYV

SEQ ID NO: 291 - protein, 440 aa, Escherichia coli; identical to SEQ ID NO: 219

SEQ ID NO: 292 - protein, 479 aa, Hordeum vulgare
MKGGELLVLLLASSLCLSAAVAAQETCPADIGAKCTDAASDDWEGEFFPGIDKINYEGPTSKKPLSYKWYNAEEVILGKKMKDWFRFSVAFWHTFRGTGGDPFGAPTKNWPWEDGTNSLAMAKRRMKAHFEFMEKLGVERWCFHDRDIAPDGKTLAETNANLDEIVELAKQLQSETNIKPLWGTAQLFMHPRYMHGAATSPEVKVYAYAAAQVKKALEVTHYLGGENYVFWGGREGYQTLLNTDMKRELEHLANFLQAAVNHKKKIGFNGTLLIEPKPQEPTKHQYDWDVATTFSFLQKFGLTGEFKINVECNHATLSGHSCHHELETARINDILGNIDANTGDPQVGWDTDEFLTDISEATLIMSSVVKNDGLAPGGFNFYAKLRRESTDVEDLFIAHISGMDTMARGRRNVVKLIEDGSLDELVRKRYQSFDTEIGAMIEAGKGDFETLEKKALEWGEPTVPSGKQELAEMLFQSAL

SEQ ID NO: 293 - protein, 434 aa, Dinoroseobacter shibae
MSDFFAGIPAVTYEGPEARSDFAFRHYNPDEMVMGKRMEDQLRFAVAWWHSFAWEGGDPFGGPTFQRPWFGDTLDHARAKADAAFEMFRILNVPFYCFHDADIRPEGASFAETTANLEAMVDYLGQKQEASGKRLLWGTANLFSHRRYMAGAATNPDPDVFAYAAATIKTCMDATHKLGGANYVLWGGREGYETLLNTDLGREREQAGRMLQMVVDYKHKIGFEGTILLEPKPQEPTKHQYDYDVATVFSFLSEFGLQDEVKMNIEQGHAILAGHSFEHELALAREFGILGSIDMNRNDYQSGWDTDQFPNNIPEVALAYYEILRAGGFDTGGTNFDSKLRRQSLDPADLIAAHVAAMDVCAAGLKAAARMLEDGELEQRREDRYAGWRAPSAEAMLNGGKLEDCFAHVMETGLDPQPVSGGQERLEALVARYL

SEQ ID NO: 294 - protein, 433 aa, Rhodobacter sphaeroides
MTDFFAGIPQIRYEGEGSSNEFAFRHYNPDEVILGKRMEDHLRFAVAWWHSFAWPGGDPFGGQTFDRPWFGDTLDLAKLKADVAFEMFDILGAPFFCFHDADIRPEGATFAESKRNLEEIVDHIGIRMEGSKTKLLWGTANLFSHRRFMSGAATNPDPDVFAWSAATVKGCMDATMKLGGANYVLWGGREGYETLLNTDLTREAENAGRFLQMVVDYKHKIGFQGTILIEPKPQEPSKHQYDYDVATVYGFLKRFGLEKEVKLNIEQGHAILAGHSFEHELALAASLGILGSIDMNRNDYQSGWDTDQFPHNHPEMALAYYEILRAGGFTTGGTNFDAKIRRQSLDPEDLVLAHVGGMDTCARALKAAARLYEDGSLETARAARYAGWETPEAQAMLASSLEKIEARVLAEGINPEPRSGRQERLENLWNRFV

SEQ ID NO: 295 - protein, 437 aa, Actinobacillus succinogenes
MTNYFDKIEKVNYEGADSINPFAYKYYNANEVILGKTMADHLRLAVCYWHTFCWNGNDMFGVGSLDRSWQKQTDPLAGAKQKADIAFEFLTKLGVPYYCFHDVDIAPEGNSYQEYVNNFNTIVDVLEQKQAETGIKLLWGTANCFTNPRYMSGAATNPNPEIFARAGAQVFNAMNATKRLGGENYVLWGGREGYETLLNTDLRREREQIGRFMQMVVEHKHKIGFKGTLLIEPKPQEPTKHQYDYDVATVYGFLKQFGLEKEIKVNIEANHATLAGHTFQHEIATAAALDILGSIDANRGDPQLGWDTDQFPNSVEENTLAIYEILKAGGLTTGGLNFDAKIRRQSIDPYDLFHAHIGAIDVLALSLRRAAKMLEDQTLQHIVEQRYAGWNGELGQQILNGKSSLEALAQAAQHLEPQPVSGQQEYLENLVNSYIYR

SEQ ID NO: 296 - protein, 445 aa, Bacillus pumilus
MANSNMKTLHSLEGIGKIQFEGKQSKNPLAFKSYNPSEVIGGKTMKDHLRFSVAYWHTLTADGTDMFGTGTMQRAWDSYSGMDLAKARLEVAFQLFDLLDVPYFSFHDRDIAPEGDTLQETNQHLDIILERMKEYMRDSGVKLLWNTANMFKHPRFVHGAATSCHADVFAYAAAQVKKGIETAKELRAENYVFWGGREGYDTLLNTDMKRELDHMASFLHMAVDYAKEIGYTGQFLIEPKPKEPTTHQYDADAATSIAFLKQYGLDTHFKLNIEANHATLAGHTFEHELRVARIHGLLGSVDANQGNTLLGWDTDEFPTDLYATTLAMYEILQNGGLGTGGLNFDAKVRRASFELEDILYAHIAGMDAFAKGLRVAHRLIEDRVFEDVIKHRYRSFSEGIGRDISEGKANFHILEEYALKHPLIRNESGREEQLKARLNQYLLED

SEQ ID NO: 297 - protein, 440 aa, Escherichia coli; identical to SEQ ID NO: 160

SEQ ID NO: 298 - protein, 438 aa, Pseudomonas syringae
MSYFPTVDKVIYEGPDSDSPLAFRHYDADKRVLGKPMREHLRMAACYWHTFVWPGADMFGVGTFKRPWQRAGDPMELAIGKAEAAFEFFSKLGIDYYSFHDTDVAPEGSSIKEYRNNFAQMVDRLERHQEQSGIKLLWGTANCFSNPRFAAGAASNPDPEVFAYAGAQVFSAMNATQRLKGSNYVLWGGREGYETLLNTDLKREREQLGRFMRMVVEHKHKIGFKGDLLIEPKPQEPTKHQYDYDSATVFGFLHQYGLQDEIKVNIEANHATLAGHSFHHEIATAVSLGIFGSIDANRGDPQNGWDTDQFPNSVEEMTLATYEILKAGGFTHGGYNFDSKVRRQSLDDVDLFHGHVAAMDVLALSLERAAAMVQNDKLQQFKDQRYAGWQQPFGQSVLSGGFSLASLAEHAFANELNPQAVSGRQELLEGVVNRFIYT

SEQ ID NO: 299 - protein, 440 aa, Burkholderia vietnamiensis
MSYFEHIPAIRYEGPQSDNPLAYHHYDPAKRVLGKTLAEHLRIAVCYWHTFVWPGHDMFGQGTFVRPWQQPGDPLERARMKADAAFEFFSKLGTPFYTFHDTDVAPEGDNLREYTANFARMVDYLGERQQASGVRLLWGTANLFSHPRFAAGAATNPNPDVFAWAATQVRHALDATHRLGGENYVLWGGREGYETLLNTDLKRERDQFARFLSMVVEHKHRIGFNGALLIEPKPQEPTKHQYDYDVATVHGFLVQYGLQDEIRVNIEANHATLAGHSFHHEIANAFALGVFGSVDANRGDPQNGWDTDQFPNSVEELTLAFYEILRHGGFTTGGMNFDAKVRRQSVAAEDLFYGHVGAIDVLALALERAAVLVENDRLDALRRQRYAQWDDAFGRKILSGGYTLQSLADDALARGVNPQHVSGAQERLENIVNQAIYALR

SEQ ID NO: 300 - protein, 440 aa, Escherichia coli; identical to SEQ ID NO: 216

SEQ ID NO: 301 - protein, 439 aa, Haemophilus influenzae; identical to SEQ ID NO: 197

SEQ ID NO: 302 - protein, 439 aa, Haemophilus influenzae
MTTYFDKIEKISFEGEKSTNPFAFKHYDANQVILGKTMAEHLRLAVCYWHTFCWNGNDMFGLGSLERSWQKNPNVLAGAEQKADIAFEFLNKLGVPYYCFHDVDIAPEGNSVREYVQNFHHIVDILERKQVETGVKLLWGTANCFTNPRYMSGAATNPNPEVFAWAATQVFNAMNATQRLGGENYVLWGGREGYETLLNTDLKREREQIGRFMQMVVEHKHKIGFKGTLLIEPKPQEPTKHQYDYDVATVYGFLKQFGLEKEIKVNIEANHATLAGHTFQHEIATACALDIFGSIDANRGDPQLGWDTDQFPNSVEENTLVMYEILKHGGFTTGGFNFDAKIRRQSIDPYDLFYAHIGAIDVLALSLKRAAKMLQEKTLQKIVNARYAGWNSELGQHILQGKTSLETLAQLVQQKDLAPKPVSGQQEYLENLVNQVIYS

SEQ ID NO: 303 - protein, 435 aa, Listeria welshimeri
MTYFKQIEKINYEGVQSGNRFAFRHYNPEEVVLGKSMKEHLRFAVAYWHTMTQDGSDPFGAATNVRDVSGKTEMELARNRVEMFFEILEKLGVEYFCFHDVDIAPEGNSLQEFMRNLDEITDLIQDKMKQTGIKLLWNTANLFTHPRFLNGAASTNNADVYAFSAAQIKKGLDISKKLGGKNYVFWGGREGYESLLNTDMEFEQANMARMYKMAIRYANEIEHEVQFLIEPKPKEPTKHQYDFDAATTMAFLQKYGLENDFKLNLEANHATLAGHTFEHELNVARTYNALGSIDANQGDLLLGWDTDEFPTNIYDTTLTMYEILQNGGIAPGGINFDAKVRRTSFEMEDLLLAHIAGMDTYARGLKAAAKLTEDHFFDKIKEERYRSFKKGIGARILDNQEDFKSLTEYALAHDSIQNESSHIEYVKSRLNDYLV

SEQ ID NO: 304 - protein, 438 aa, Thermoanaerobacter yonseiensis
MEYFKNVPKVQYEGPKSNNPYAFKFYNPDEIIDGKPLKEHLRFAVAYWHTFTGTGTDPFGASTMQRPWDRFSDPMDIAKARVEAAFEFFEKLDVPFFCFHDRDIAPEGDNLRETNKNLGTIVAMIKDYLKTSKAKVLWGTANLFSHPRYVHGAATSCNADVFAYAAAQVKKALEITKELGGQNYVFWGGREGYETLLNTDTELELDNLARFLHMAVEYAKEIGFEGQLLIEPKPKEPTKHQYDFDAAHVYAFLKKYGLDKYFKLNIEVNHATLAGHEFQHELRYARINNILGSIDANMRDMLLGWDTDQFPTDIRMTTLAMYEVIKMGGFDKGGLNFDAKVRRASFEPEDLFIAHIAGMDAFAKGFKVAYRLVKDGVFDKFIEERYKSYKEGIGAEIVSGRANFKTLEEYALNNPKIENKSGKQELLESILNQYLFTE

SEQ ID NO: 305 - protein, 445 aa, Geobacillus kaustophilus
MAYFPNIGTIPYEGPESRNPLAFKFYNPDEKVGGKTMEEHLRFSVAYWHTFTGDGSDPFGVGNMIRPWNTYSGMDLAKARVEAAFELFEKLNVPFFCFHDVDIAPEGETLSETYKNLDEIVDMIEEYMKTSKTKLLWNTANLFSHPRFVHGAATSCNADVFAYAAAKVKKGLEIAKRLGAENYVFWGGREGYETLLNTDMKLELDNLARFLHMAVDYAKEIGFDGQFLIEPKPKEPTKHQYDFDVATALAFLQTYGLKDHFKFNIEANHATLAGHTFEHELRVARIHGMLGSVDANQGDTLLGWDTDEFPTDLYTTTLAMYEILQNGGLGRGGLNFDAKVRRGSFEPEDLFYAHIAGMDSFAIGLKVAHRLLEDRVFEQFIEERYKSYTEGIGREIVEGTADFKKLEEYALQLGDIRNTSGRLERLKTLLNQYLLEVSAPSGSRS

SEQ ID NO: 306 - protein, 437 aa, Mannheimia succiniciproducens
MTNYFDKIEKVKYEGADSTNPFAYKHYNANEVILGKTMAEHLRLAVCYWHTFCWNGNDMFGVGSLDRSWQKMSDPLAAAKQKADIAFEFLTKLGVPYYCFHDVDIAPEGNSYQEYVRNFNTIVDILEQKQAESGVKLLWGTANCFSNPRYMSGAATNPNPEIFTRAAAQVFNAMNATKRLGGENYVLWGGREGYETLLNTDLRREREQIGRFMQMVVEHKHKIGFSGTLLIEPKPQEPTKHQYDYDVATVYGFLKQFGLEKEIKVNIEANHATLAGHTFQHEIATAAALDILGSIDANRGDPQLGWDTDQFPNSVEENTLAIYEILKAGGLTTGGFNFDAKIRRQSINPYDLFHGHIGAIDVLALSLKRAAKMVEDHTLQNIVDQRYAGWNGELGQQILAGKSSLEALAQAAQNLDPNPVSGQQEYIENLVNGYIYR

SEQ ID NO: 307 - DNA, 1098 bp, artificial sequence
  LoxPw-aadA-LoxPw PCR fragment
ataacttcgtataatgtatgctatacgaagttatgcggccgcagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgactgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtacttgcgatggcatcggggcaggcacttgctgacctgccttaattaaataacttcgtataatgtatgctatacgaagttat

SEQ ID NO: 308 - DNA, 1182 bp, artificial sequence
  codon optimized coding region of Actinoplanes missouriensis xylose isomerase for expression in Zymomonas
atgagtgtccaagctacacgcgaagataaatttagctttggcttgtggacagttgggtggcaggcccgtgacgcctttggtgatgccacgcgtaccgcccttgatccggtcgaagcagttcataaacttgccgaaatcggagcctatggcattacatttcatgatgatgacttggtccccttcggttcggatgctcagacacgggatggtatcattgctggtttcaaaaaagcccttgatgaaaccggtttgatcgttcctatggttaccacaaatttgtttacgcatccggtttttaaagacggcgggtttacctctaacgatcgttctgtgcgccggtatgctatccggaaagttttgagacagatggatcttggtgcggaactgggggccaaaacgcttgtcttatggggcggcagagaaggtgcggaatatgattcagcaaaagatgttagtgccgccttggatcgttatcgcgaagcactgaatcttctggcacaatatagcgaagacagaggctatggacttcgttttgcaattgaaccgaaacctaatgaaccacgtggcgatattctgctgcctaccgcaggccatgctattgcctttgtgcaagaattagaacggcccgaactttttggcatcaatccagaaaccgggcatgaacagatgtcaaacttgaattttacccaggggattgctcaggctttgtggcataaaaaactttttcatattgatttgaatggacaacatggtcccaagtttgatcaggaccttgtctttggtcatggtgaccttttaaatgcctttagcctggtcgatttgttagaaaatggtccagatggtgccccggcttatgatggcccgcgccattttgattataaaccatctcgtactgaagattatgatggcgtttgggaatcagcgaaagccaatatccgtatgtatcttttattaaaagaacgtgccaaagcgtttagagctgatccggaagttcaggaagcactggcagcaagcaaagttgccgaattgaaaaccccaacgttgaatcctggtgaaggctatgcagaactgttagcagatcgcagtgcttttgaagattatgatgccgatgctgttggtgcgaaaggttttggtttcgtgaaattgaaccaattggccattgaacatttattaggtgcccgc

SEQ ID NO: 309 - DNA, 1347 bp, artificial sequence
  codon optimized coding region for lLactobacillus brevis xylose isomerase for expression in Zymomonas
atgaccgaagaatattggaaaggagtggacaaaattcagtatgttggtcatcaggacaaaaagtccggtctggggtttcaatattataatccggaagaagaaattatgggaaaaaagatgaaagactggttgcgtttcgccgttgcttattggcatacctttgatcaacgcttggttgatccatttggtgatggcaccgcccagcgcccgtatgacaagtatacagatcctatggatttggctctggctaaagttgatgctgcttttgaattttatcagaaattaggagtggattatttatgcttccatgatcgtgatttggctcctgaaggtgatacactgcgcgaaacaaacgctaatctggataaggttgttgataaaattgtggaatatcagaaaacaagcggaatgaaagttctttggaatacctctaatatgtttacgaaccccagattcgtcgaaggtgctgctacctccccctatgccgatgtcttcgcatatagcgctgcacaacttaagcattctctggaaattggtaagcgcgtcggttcggaaaattatgttttctggggcggaagagaaggttatgaatctttgtggaatacgaatatgaagcaagaacaagaacatgccgcgaaaatttttcatatggcaaaggattatgcaaatgaaatcggctttgatgcgcaaatgctgttagaacctaaaccgaaagaaccgaccacccatcaatatgatttcgatgccgctacaacgattgccttcatgaaagaatatgatttagataaagatttcaaattgaatttggaaggcaatcatgctaatctggcaggacatacctatcaacatgaaattcgggttgcccgcgaagctggcctgctggggtcgttagatgctaatcagggagataaattaattggttgggatatcgatgaatatcctagcaatttgtatgaaacgaccgctgctatgtatgaagttgtcgaaaacggatcaatcggcccgcgtggtggcttaaattttgatgccaaaccccgccgtagcagttttgcccctgaagacttgtttttgggtcatattgttggcatggattcttttgccgccggtttgcgtgtcgccgctgctatgaaacaggatggctttttagattctttgaaagcggaccggtatagctcttataaatctggcgttggcgccgatatcgaatcaggcaaagccgacctgaaatctcttgaagcatatgccattgataaaccgcaatctgaacttatcgcagccacgcattccgatcatttagaagaaattaaagacacaattaatcattatatcattgatactctttcaaaa

SEQ ID NO: 310 - DNA, 1320 bp, artificial sequence
  codon optimized coding region of E. coli xylose isomerase for expression in Zymomonas
atgcaggcttattttgatcagctggatcgcgtgcggtatgaaggctctaagtcaagtaatcctttagcctttcgtcattataatcctgatgaattagtgctgggtaaacgtatggaagaacatcttagatttgctgcttgctattggcataccttttgttggaatggtgcagatatgtttggggttggagcttttaatcggccttggcagcagcctggggaagcattggcccttgccaagcggaaagcggatgttgcctttgaatttttccataaattgcatgtccctttctattgctttcatgatgtcgatgtctcccctgaaggcgctagcctgaaagaatatatcaataatttcgcgcaaatggttgacgtcttagctggtaagcaggaagaaagcggcgtgaaacttttgtggggtacagcaaattgttttaccaatcctcgttatggtgcgggcgcagctaccaatccggatccggaagtttttagctgggctgccacacaagttgtcacagctatggaagctacacataaattggggggtgaaaattatgttttgtggggtggtcgtgaagggtatgaaacgttattaaatacagatctgcgccaagaacgcgaacagttgggtcgttttatgcaaatggtggttgaacataaacataaaattggcttccaggggacccttcttattgaaccgaaaccgcaagaaccgaccaagcatcaatatgattatgatgcagcgacggtttatggcttcttgaaacagtttggtttagaaaaagaaattaaacttaatattgaagccaaccatgccactcttgcgggccattcctttcatcatgaaatcgctacagccattgcgctgggattgttcggtagtgttgatgctaatcgcggcgatgcccaattgggttgggatacagatcaatttcccaattcagtcgaagaaaatgcgctggttatgtatgaaattttgaaggcaggcggatttaccactggtggtttgaattttgatgcgaaagttcgtcgccagtcaaccgataagtatgatttgttctatggacatatcggtgcgatggatactatggccttagcacttaaaattgctgcacgtatgatcgaagatggcgaacttgataaacgcattgcccaacgctattcggggtggaatagcgaattagggcagcagattttaaaaggacaaatgtcgttagcggatttagccaagtatgcccaggaacatcatctgtctccggtgcatcaatcgggtcgtcaagaacaacttgaaaatttagtgaatcattatctgtttgacaaa

SEQ ID NO: 311 - DNA, 305 bp, Zymomonas mobilis
gttcgatcaacaacccgaatcctatcgtaatgatgttttgcccgatcagcctcaatcgacaattttacgcgtttcgatcgaagcagggacgacaattggctgggaacggtatactggaataaatggtcttcgttatggtattgatgtttttggtgcatcggccccggcgaatgatctatatgctcatttcggcttgaccgcagtcggcatcacgaacaaggtgttggccgcgatcgccggtaagtcggcacgttaaaaaatagctatggaatataatagctacttaataagttaggagaataaac

SEQ ID NO: 312 - DNA, 166 bp, Escherichia coli
tgactgtataaaaccacagccaatcaaacgaaaccaggctatactcaagcctggttttttgatggattttcagcgtggcgcaggcaggttttatcttaacccgacactggcgggacaccccgcaagggacagaagtctccttctggctggcgacggacaacgggcc

SEQ ID NO: 313 - DNA, 10441 bp, artificial sequence
  constructed plasmid
ctagttcgatcaacaacccgaatcctatcgtaatgatgttttgcccgatcagcctcaatcgacaattttacgcgtttcgatcgaagcagggacgacaattggctgggaacggtatactggaataaatggtcttcgttatggtattgatgtttttggtgcatcggccccggcgaatgatctatatgctcatttcggcttgaccgcagtcggcatcacgaacaaggtgttggccgcgatcgccggtaagtcggcacgttaaaaaatagctatggaatataatagctacttaataagttaggagaataaacatggcgattgcaattggcctcgattttggcagtgattctgtgcgagctttggcggtggactgcgctaccggtgaagagatcgccaccagcgtagagtggtatccccgttggcagaaagggcaattttgtgatgccccgaataaccagttccgtcatcatccgcgtgactacattgagtcaatggaagcggcactgaaaaccgtgcttgcagagcttagcgtcgaacagcgcgcagctgtggtcgggattggcgttgacagtaccggctcgacgcccgcaccgattgatgccgacggaaacgtgctggcgctgcgcccggagtttgccgaaaacccgaacgcgatgttcgtattgtggaaagaccacactgcggttgaagaagcggaagagattacccgtttgtgccacgcgccgggcaacgttgactactcccgctacattggtggtatttattccagcgaatggttctgggcaaaaatcctgcatgtgactcgccaggacagcgccgtggcgcaatctgccgcatcgtggattgagctgtgcgactgggtgccagctctgctttccggtaccacccgcccgcaggatattcgtcgcggacgttgcagcgccgggcataaatctctgtggcacgaaagctggggcggcctgccgccagccagtttctttgatgagctggacccgatcctcaatcgccatttgccttccccgctgttcactgacacttggactgccgatattccggtgggcaccttatgcccggaatgggcgcagcgtctcggcctgcctgaaagcgtggtgatttccggcggcgcgtttgactgccatatgggcgcagttggcgcaggcgcacagcctaacgcactggtaaaagttatcggtacttccacctgcgacattctgattgccgacaaacagagcgttggcgagcgggcagttaaaggtatttgcggtcaggttgatggcagcgtggtgcctggatttatcggtctggaagcaggccaatcggcgtttggtgatatctacgcctggtttggtcgcgtactcggctggccgctggaacagcttgccgcccagcatccggaactgaaaacgcaaatcaacgccagccagaaacaactgcttccggcgctgaccgaagcatgggccaaaaatccgtctctggatcacctgccggtggtgctcgactggtttaacggccgccgcacaccgaacgctaaccaacgcctgaaaggggtgattaccgatcttaacctcgctaccgacgctccgctgctgttcggcggtttgattgctgccaccgcctttggcgcacgcgcaatcatggagtgctttaccgatcaggggatcgccgttaataacgtgatggcactgggcggcatcgcgcggaaaaaccaggtcattatgcaggcctgctgcgacgtgctgaatcgcccgctgcaaattgttgcctctgaccagtgctgtgcgctcggtgcggcgatttttgctgccgtcgccgcgaaagtgcacgcagacatcccatcagctcagcaaaaaatggccagtgcggtagagaaaaccctgcaaccgtgcagcgagcaggcacaacgctttgaacagctttatcgccgctatcagcaatgggcgatgagcgccgaacaacactatcttccaacttccgccccggcacaggctgcccaggccgttgcgactctataaggacacgataatgacgatttttgataattatgaagtgtggtttgtcattggcagccagcatctgtatggcccggaaaccctgcgtcaggtcacccaacatgccgagcacgtcgttaatgcgctgaatacggaagcgaaactgccctgcaaactggtgttgaaaccgctgggcaccacgccggatgaaatcaccgctatttgccgcgacgcgaattacgacgatcgttgcgctggtctggtggtgtggctgcacaccttctccccggccaaaatgtggatcaacggcctgaccatgctcaacaaaccgttgctgcaattccacacccagttcaacgcggcgctgccgtgggacagtatcgatatggactttatgaacctgaaccagactgcacatggcggtcgcgagttcggcttcattggcgcgcgtatgcgtcagcaacatgccgtggttaccggtcactggcaggataaacaagcccatgagcgtatcggctcctggatgcgtcaggcggtctctaaacaggatacccgtcatctgaaagtctgccgatttggcgataacatgcgtgaagtggcggtcaccgatggcgataaagttgccgcacagatcaagttcggtttctccgtcaatacctgggcggttggcgatctggtgcaggtggtgaactccatcagcgacggcgatgttaacgcgctggtcgatgagtacgaaagctgctacaccatgacgcctgccacacaaatccacggcaaaaaacgacagaacgtgctggaagcggcgcgtattgagctggggatgaagcgtttcctggaacaaggtggcttccacgcgttcaccaccacctttgaagatttgcacggtctgaaacagcttcctggtctggccgtacagcgtctgatgcagcagggttacggctttgcgggcgaaggcgactggaaaactgccgccctgcttcgcatcatgaaggtgatgtcaaccggtctgcagggcggcacctcctttatggaggactacacctatcacttcgagaaaggtaatgacctggtgctcggctcccatatgctggaagtctgcccgtcgatcgccgcagaagagaaaccgatcctcgacgttcagcatctcggtattggtggtaaggacgatcctgcccgcctgatcttcaatacccaaaccggcccagcgattgtcgccagcttgattgatctcggcgatcgttaccgtctactggttaactgcatcgacacggtgaaaacaccgcactccctgccgaaactgccggtggcgaatgcgctgtggaaagcgcaaccggatctgccaactgcttccgaagcgtggatcctcgctggtggcgcgcaccataccgtcttcagccatgcactgaacctcaacgatatgcgccaattcgccgagatgcacgacattgaaatcacggtgattgataacgacacacgcctgccagcgtttaaagacgcgctgcgctggaacgaagtgtattacggatttcgtcgctaagtctagagaaggagtcaacatgttagaagatctcaaacgccaggtattagaagccaacctggcgctgccaaaacacaacctggtcacgctcacatggggcaacgtcagcgccgttgatcgcgagcgcggcgtctttgtgatcaaaccttccggcgtcgattacagcgtcatgaccgctgacgatatggtcgtggttagcatcgaaaccggtgaagtggttgaaggtacgaaaaagccctcctccgacacgccaactcaccggctgctctatcaggcattcccctccattggcggcattgtgcatacgcactcgcgccacgccaccatctgggcgcaggcgggtcagtcgattccagcaaccggcaccacccacgccgactatttctacggcaccattccctgtacccgcaaaatgaccgacgcagaaatcaacggcgaatatgagtgggaaaccggtaacgtcatcgtagaaacctttgaaaaacagggtatcgatgcagcgcaaatgcccggcgttctggtccattcccacggcccgtttgcatggggcaaaaatgccgaagatgcggtgcataacgccatcgtgctggaagaggtcgcttatatggggatattctgccgtcagttagcgccgcagttaccggatatgcagcaaacgctgctggataaacactatctgcgtaagcatggcgcgaaggcatattacgggcagtaatgactgtataaaaccacagccaatcaaacgaaaccaggctatactcaagcctggttttttgatggattttcagcgtggcgcaggcaggttttatcttaacccgacactggcgggacaccccgcaagggacagaagtctccttctggctggcgacggacaacgggccaagcttggaagggcgaattcgcgatcgcataacttcgtataatgtatgctatacgaagttatgcggccgcagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgactgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtacttgcgatggcatcggggcaggcacttgctgacctgccttaattaaataacttcgtataatgtatgctatacgaagttatggccggccaattcatggttttggtgccaatgttatcgcctataaaccgcatccagaccccgaattggcgaaaaaggtcggtttccgcttcacctctctcgatgaagtgatcgagaccagcgacatcatttcgcttcactgtccgctcacgccagaaaatcatcacatgattaatgaagaaacactggcaagggcaaaaaaaggcttttacctcgtcaataccagtcgcggcggcttggttgataccaaggcggtgattaaatcgctgaaagccaaacatctcggcggttatgcggcggatgtttacgaagaggaggggcctttattcttcgaaaatcacgctgacgatattatcgaagatgatattctcgaaaggttgatcgctttcccgaatgtggttttcacgggacatcaggcctttttgacgaaagaggccttatcaaacattgctcacagtattctacaagatatcagcgatgccgaagctggaaaagaaatgccggatgcgcttgtttagtagacaagcgacaattaaccttttgaagatcataatgatcaaatttttgggttaattcggtagttatggcataggctattacgcgctaattgatatcaaaaaaaagcatagccggacatcataccggctatgttttttattaggaaaaaatttcctttcaccttgcttagccatcgccgcattatttaatcaatatgccgagtttttcttgaaatccctatcttacaccaaggccaacaagggaatcatccatactcggtgtcctatcctatgactttttaaattttctccaaatttactaaaatcacgccatctcagcggctgctattttcaaaaagcgcctctcaaaaccgctttttcctgctcaaatatcggatcccaaaattccctcaaaaaaggcagggtattttttacaaaatcgcccctaatatctctcaatccgctgccttgttcatatgtttttgcaaatgatttttattaaacttttttaggcgtatttttatcaagaaaatttaaataatcacatttttattattttagatttaagtattgatacaagtgatatctataaatgtttttataactttctggatcgtaatcggctggcaatcgttttccctatattcgcaagatgtatgtcagccgcgcggccgctggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctcgtttttctatccccatcacctcggttttgttgacaaaaaaaggtggccactaaattggctttccgcaccgatgggatgatttttattctttgctattcttcgctctttgcccaattcattaaaagcggaaatcatcaccaaagatagaagacgcagccttcaccatttcagattgcccttctcgggcattttctgctgctagaatcctcttaaaaatattaaattccactctattggtaatatgtttccctctttagggaacaaataaagcccttctttgttctataaaagttagcttaccgattttacaaaaaataataccgcttcattcaatcggtaatacatatcttttttcttcaaaaaacttttcaagagggtgtctatgcgcgtcgcaatattcagttccaaaaactatgaccatcattctattgaaaaagaaaatgaacattatggccatgaccttgtttttctgaatgagcggcttaccaaagagacagcagaaaaagccaaagacgcagaagctgtttgtatctttgtgaatgacgaagccaatgccgaagtgctggaaattttggcaggcttaggcatcaagttggttgctcttcgttgcgccggttataacaatgtcgatctcgatgcggccaaaaagctgaatatcaaggttgtgcgcgtgcctgcctattcgccctattcggttgccgaatatgcagtagggatgttgctcaccctgaatcggcaaatttcacgcggtttgaagcgggttcgggaaaataacttctccttggaaggtttgattggccttgatgtgcatgacaaaacagtcggcattatcggtgttggtcatatcgggagcgtctttgcccatattatgaccca

SEQ ID NO: 314 - DNA, 38 bp, artificial sequence
  primer
aaatcaggcctactagtgttcgatcaacaacccgaatc

SEQ ID NO: 315 - DNA, 38 bp, artificial sequence
  primer
cgtgtagcttggacactcatgtttattctcctaactta

SEQ ID NO: 316 - DNA, 39 bp, artificial sequence
  primer
ctgatcaaaataagcctgcatgtttattctcctaactta

SEQ ID NO: 317 - DNA, 38 bp, artificial sequence
  primer
ttccaatattcttcggtcatgtttattctcctaactta

SEQ ID NO: 318 - DNA, 42 bp, artificial seuqence
  primer
tatggctttcgccgttaatctagatgactgtataaaaccaca

SEQ ID NO: 319 - DNA, 39 bp, artificial sequence
  primer
ttatgaattcaagcttggccggcccttccaagcttggcc

SEQ ID NO: 320 - DNA, 38 bp, artificial sequence
  primer
taagttaggagaataaacatgagtgtccaagctacacg

SEQ ID NO: 321 - DNA, 44 bp, artificial sequence
  primer
tgtggttttatacagtcatctagactagcgggcacctaataaat

SEQ ID NO: 322 - DNA, 39 bp, artificial sequence
  primer
taagttaggagaataaacatgcaggcttattttgatcag

SEQ ID NO: 323 - DNA, 45 bp, artificial sequence
  primer
tgtggttttatacagtcatctagattatttgtcaaacagataatg

SEQ ID NO: 324 - DNA, 38 bp, artificial sequence
  primer
taagttaggagaataaacatgaccgaagaatattggaa

SEQ ID NO: 325 - DNA, 44 bp, artificial sequence
  primer
tgtggttttatacagtcatctagattattttgaaagagtatcaa

SEQ ID NO: 326 - DNA, 34 bp, artificial sequence
  primer
atgggagctcgtttttctatccccatcacctcgg

SEQ ID NO: 327 - DNA, 35 bp, artificial sequence
  primer
atcgactagtgggtcataatatgggcaaagacgct

SEQ ID NO: 328 - DNA, 895 bp, artificial sequence
  LDH-L PCR fragment
atgggagctcgtttttctatccccatcacctcggttttgttgacaaaaaaaggtggccactaaattggctttccgcaccgatgggatgatttttattctttgctattcttcgctctttgcccaattcattaaaagcggaaatcatcaccaaagatagaagacgcagccttcaccatttcagattgcccttctcgggcattttctgctgctagaatcctcttaaaaatattaaattccactctattggtaatatgtttccctctttagggaacaaataaagcccttctttgttctataaaagttagcttaccgattttacaaaaaataataccgcttcattcaatcggtaatacatatcttttttcttcaaaaaacttttcaagagggtgtctatgcgcgtcgcaatattcagttccaaaaactatgaccatcattctattgaaaaagaaaatgaacattatggccatgaccttgtttttctgaatgagcggcttaccaaagagacagcagaaaaagccaaagacgcagaagctgtttgtatctttgtgaatgacgaagccaatgccgaagtgctggaaattttggcaggcttaggcatcaagttggttgctcttcgttgcgccggttataacaatgtcgatctcgatgcggccaaaaagctgaatatcaaggttgtgcgcgtgcctgcctattcgccctattcggttgccgaatatgcagtagggatgttgctcaccctgaatcggcaaatttcacgcggtttgaagcgggttcgggaaaataacttctccttggaaggtttgattggccttgatgtgcatgacaaaacagtcggcattatcggtgttggtcatatcgggagcgtctttgcccatattatgacccactagtcgat

SEQ ID NO: 329 - DNA, 33 bp, artificial sequence
  primer
gcgaattcatggttttggtgccaatgttatcgc

SEQ ID NO: 330 - DNA, 35 bp, artificial sequence
  primer
ttaggcggccgcgcggctgacatacatcttgcgaa

SEQ ID NO: 331 - DNA, 1169 bp, artificial sequence
  LDH-R PCR fragment
gcgaattcatggttttggtgccaatgttatcgcctataaaccgcatccagaccccgaattggcgaaaaaggtcggtttccgcttcacctctctcgatgaagtgatcgagaccagcgacatcatttcgcttcactgtccgctcacgccagaaaatcatcacatgattaatgaagaaacactggcaagggcaaaaaaaggcttttacctcgtcaataccagtcgcggcggcttggttgataccaaggcggtgattaaatcgctgaaagccaaacatctcggcggttatgcggcggatgtttacgaagaggaggggcctttattcttcgaaaatcacgctgacgatattatcgaagatgatattctcgaaaggttgatcgctttcccgaatgtggttttcacgggacatcaggcctttttgacgaaagaggccttatcaaacattgctcacagtattctacaagatatcagcgatgccgaagctggaaaagaaatgccggatgcgcttgtttagtagacaagcgacaattaaccttttgaagatcataatgatcaaatttttgggttaattcggtagttatggcataggctattacgcgctaattgatatcaaaaaaaagcatagccggacatcataccggctatgttttttattaggaaaaaatttcctttcaccttgcttagccatcgccgcattatttaatcaatatgccgagtttttcttgaaatccctatcttacaccaaggccaacaagggaatcatccatactcggtgtcctatcctatgactttttaaattttctccaaatttactaaaatcacgccatctcagcggctgctattttcaaaaagcgcctctcaaaaccgctttttcctgctcaaatatcggatcccaaaattccctcaaaaaaggcagggtattttttacaaaatcgcccctaatatctctcaatccgctgccttgttcatatgtttttgcaaatgatttttattaaacttttttaggcgtatttttatcaagaaaatttaaataatcacatttttattattttagatttaagtattgatacaagtgatatctataaatgtttttataactttctggatcgtaatcggctggcaatcgttttccctatattcgcaagatgtatgtcagccgcgcggccgcctaa

SEQ ID NO: 332 - DNA, 20 bp, artificial sequence
  primer
ccagtatcagcccgtcatac

SEQ ID NO: 333 - DNA, 26 bp, artificial sequence
  primer
tctcggagagatagaggtcagtcgac

SEQ ID NO: 334 - DNA, 20 bp, artificial sequence
  primer
gccttgggcttttaaagcct

SEQ ID NO: 335 - DNA, 1191 bp, Geodermatophilus obscurus
atgaccgctccgcagcctacgaaagatgatcgctttacctttggtttatggacggttggctggcaagcccgggatccttttggtgatgccacccgtcctgctctggatcccgttgaatctgtccatcggctggccgaattgggtgccgctggcgttacgtttcatgatgatgatttgattccctttggcagcgaagatgcggaacgcgccaaacatgtccagcggtttaccgatgccctggaagaaaccggtttggttgttccgatggccaccacgaatttgtttacccatccggtctttaaagaaggcgctcttacggcgaatgatcgtgatgttcgtcgctatgctttgcgcaaagtcatgcggaatatggatcttgcggccgaattaggtgcccgcacctatgttctttggggtggtcgtgaaggtgctgaagtcgattccgctaaagatctgcgtgctgcgttggatcggtatcgtgaaggtattgatacgttagcgcagtattcggaagatcgtggttatggccttcgctttgccttagaacccaaaccgaatgaacctcgcggtgatatttttctgcccaccatcggccatgctttagcgtttatctctacgctggaacatgctgatcttgttggtttaaatccggaagtcggccatgaacaaatggccaatcttaattatacgcatggtattgcccaggctctttggcaaggcaaattgtttcatatcgatctgaatggtcagcatggccctaaattcgatcaagatttggttttcggtcatggcgatttgctttctgcttttggcaccgtcgatttactggaacatggtggcccgaatggtagccctgcctatgatggcccgcgtcattttgattataaacctttgcgcaccgaagatatcgatggcgtttgggcttccgccgctgcgaatatgcgtacgtatttgcttctgaaagaacgggccgctgcgtttcgtgcggatccggaagttcaggaagccttggctgctgctcgggtccccgaattggctcaaccgacccttgcggatggcgaaacgtatgaagatctgttggccgatcgtgccgcttttgaagaatttgatgctgaagctgctggtgctcgtcctggtggtcaggttcgcctgagccaattggctgtcgaacatcttttaggtgcccgttaa

SEQ ID NO: 336 - DNA, 1224 bp, Mycobacterium smegmatis
atgaccgttttggaatccaatgtctcgaccacggaaccccttacgccgaaacgcgaagatcggtttagctttggtttatggaccattggttggaatggcaatgatccttttggtgttgctacgcgcccggctctggatgttgtcgaagcggtcgaaaaactggcggaattgggtgcctatggcttaacctttcatgatgatgatctgtttgcctttggttctagcgataccgaacgtcgccggatggttgatcgtctgacgtctgcgttgagcgccaatggcatggttgtcccgatggttaccacgaatctttttacccagcctgtctttaaagatggtggctttacctccaatgatcgcacggttcgtcgctttgctcttcgtaaagtcttacgcaatattgatctggccatcgaattgggtgctgaaacgtttgttttgtggggtggccgggaaggctccgaatatgattcggccaaagatgtccaagccgctcttgcgcggtatcgtgaagctatggatttgctttgtcagtatgttattgatcaaggttctggcttgcgttttgctatcgaaccgaaacctaatgaacctcgcggtgatattttactgcccaccgtcggccatgcgttagcctttatcgatacgctggcccgtccggaaatggttggtgtcaatcctgaaaccggccatgaacagatgtctggtttaaattttatgcacggcattgctcaagcgctttatagcggtaaattgttccatatcgatctgaatggtcagcgtggcatcaaattcgatcaagatttggttttcggtcatggcgatttggccaatgcttttgcgcttgtcgatttgcttgaacatggtggccctgatggcacccccgcttatgaaggcccccgccattttgattataaaccttcccggacggaagatatcgatggcgtttgggcctcggcggccgctaatatgcgcatgtatttactgttgaaacagcgggccgaagcctttcgtgctgatcctgctgttcgtgaagctatggccgctgctaaagtcgctgaattgcgtcaaccgacccttgctcctggtgaaacgtatcatgatcttttagctgatcgctctgcgtttgaagaatttgatagcgaagcctattttggtggcaaaggttgcggctttgtcgctcttcagcaattagcgatcgaacatttgatgggcgcccgttaa

SEQ ID NO: 337 - DNA, 1188 bp, Salinispora arenicola
atggctccgcatcctacccccgcggataaattttcttttggtctttggacggttggctggcaggcccgtgatccgtttggtgatgctacccgccctgaattagatgctgttgaagcggtccatcgccttgcggaattaggtgcctatggcattacctttcatgatgatgatctgatcccttttggtgctgatgctgctacgcgtgatgctcgtttgtcccggtttcgtcgcgctctggatgaaaccggtttggttgttccgatggttaccacgaatctgtttacccatccggtttttaaagatggtggcttgacgagcaatgatcgcgatgtccggcgttatgccctgcgtaaagttttgcgcaccgtcgatcttgctgttgaattaggtgcgcggacgtttgttatgtggggtggccgtgaaggcgccgaatatgatgtcgctaaagatgttcgtgcggcccttgatcgctatcgggaagctgtcgatttgctttgtcagtatacggttgatcaaggctatgatttgcgttttgccattgaaccgaaacctaatgaaccccgcggtgatatcttactgccgaccgtcggccatgcccttgcttttattgccacgttagctcgccctgaactggtcggtttgaatcccgaagttggccatgaacagatggctggtttgaatgttacgcatggtattgcgcaggccctttggcagggtaaattgtttcatctggatttgaatggtcagcgtggcatcaaatatgatcaagatcttgtctttggtcatggcgatttgcttaatgcttttgcgttagttgatttactggaaaatggtggtcctggtggtgccccggcttatgatggtccgcgccattttgattataaaccttctcggacggaagatagcgctggtgtttgggtctctgctggtgctaatatgcgcacctatttgcttttaaaagaacgggctgcggcctttcgtgctgatccggaagtcatcgaagccttggctgcgagccgggttggtgaactggcgacccctacgttggcccccggtgaatcccatgctggcctgttggcggatcgttcggcctttgaagaatatgatgttggtgccgctgcgacccgcggctttgattttgtccggcttaatcaactggctgttgaacatcttctgggcgcccgttaa

SEQ ID NO: 338 - DNA, 1155 bp, Xylanimonas cellulosilytica
atgagcgatattaaatatgcttttggcctttggaccacgggttggcagggcgttgatccctttggtgatgccacccgtcccgctttagatccggcggaaaatatccgcaaactggccgaattgggcgctcatgcgtttacctttcatgataatgatgtttggccgattgatgcgacggatgccgaacgtgccgctgcgatcgaatccgtcaaaaaagcctcggctgaaaccggtcttgtttgtgaaatggtcaccacgaatacgttttcccatccggtctttaaagcgggcgcctttacctcgaatgatcggaatattcgtcgctatggtctgcgtaaagttttgaaacaggtcgatcttggtgccgaattaggcgcttccacgtttgttatgtggggtggccgcgaaggcgtcgaatatgccaattctaaagatttgggcaccgctcatgcgcggtatgccgaaggtattgatacggttgccgcttatatcaaatctaaaggttatgatatgcgggtcgctctggaaccgaaacctaatgaaccgcgtggcgatatttttcttcctaccatcggtcatgccattgctctgatcaatagcttggataatggtgatattgttggcgtcaatcctgaaaccggtcatgaacaaatggccggtttgaattatacgcatggtttagcgctggccttgtatgttggcaaacttttccatatcgatctgaatggtcagaatggccccaaatatgatcaagatctggttttcggtcatggcaatttgttggatgcctttttcaccgtcgatttactggaaaatggttcccctaatggcgaaattgccccctatgtcggctatcgccattttgattataaaccgtctcggaccgaatatacggatggtatctgggaaagcgcggccgctaatatgaaaacgtattctttgcttgctgaagcgagcaaagcctatcgtgccgatgctgaagttcaggcggcctttgaaaaagccggcgtcctggataaatctgctaccttggcggaaggcgaatcttttgaatcttttcttgctgaacctgatgaagatattacggaattaggtaaacgccatgaaggtttggttcatctgcatcaacttgccctgaatcatatcttgggttaa

SEQ ID NO: 339 - DNA, 304 bp, artificial sequence
  mutated promoter
gttcgatcaacaacccgaatcctatcgtaatgatgttttgcccgatcagcctcaatcgacaattttacgcgtttcgatcgaagcagggacgacaattggctgggaacggtatacttgaataaatggtcttcgttatggtattgatgtttttggtgcatcggccccggcgaatgatctatatgctcatttcggcttgaccgcagtcggcatcacgaacaaggtgttggccgcgatcgccggtaagtcggcacgttaaaaaatagctatggaatataatagctactaataagttaggagaataaac

SEQ ID NO: 340 - DNA, 34 bp, artificial sequence
  primer
gggagctcactagttcgatcaacaacccgaatcc

SEQ ID NO: 341 - DNA, 24 bp, artificial sequence
  primer
catgtttattctcctaacttatta

SEQ ID NO: 342 - DNA, 24 bp, artificial sequence
  primer
catgtttattctcctaacttatta

SEQ ID NO: 343 - DNA, 29 bp, artificial sequence
  primer
cactcgagctagcgggcacctaataaatg

SEQ ID NO: 344 - DNA, 31 bp, artificial sequence
  primer
cactcgagttatttgtcaaacagataatgat

SEQ ID NO: 345 - DNA, 44 bp, artificial sequence
  primer
cggccgaactagtcgggactcgagtgactgtataaaaccacagc

What is claimed is:

1. A recombinant bacterial strain selected from the group consisting of *Zymomonas* and *Zymobacter* comprising a heterologous nucleic acid molecule encoding a polypeptide having xylose isomerase activity wherein the polypeptide is a Group I xylose isomerase and is included in the class of enzymes identified by EC 5.3.1.5, and wherein the strain utilizes xylose as a carbon source and wherein the heterologous nucleic acid molecule encoding a polypeptide having xylose isomerase activity is not under the control of a promoter derived from *Zymomonas mobilis* glyceraldehyde-3-phosphate dehydrogenase gene that has a base substitution in a position selected from the group consisting of position 116, position 217, and both position 116 and 217; wherein the position numbers are of SEQ ID NO:311; and wherein the strain demonstrates an increase in xylose utilization of between about 1.9 fold to about 17.1 fold as compared with a strain expressing a Group II xylose isomerase.

2. A recombinant bacterial strain of claim 1 wherein the polypeptide having xylose isomerase activity gives an E-value score of 1E-15 or less when queried using a Profile Hidden Markov Model prepared using SEQ ID NOs: 2, 24, 32, 34, 42, 54, 66, 68, 78, 96, 100, 106, 108, 122, 126, 128, 130, 132, 135, 137, and 142; the query being carried out using the hmmsearch algorithm wherein the Z parameter is set to 1 billion.

3. A recombinant bacterial strain of claim 1 wherein the polypeptide having xylose isomerase activity:
1) has the following conserved amino acids when compared with the reference amino acid sequence of SEQ ID NO:66:
  a) leucine at position 226,
  b) methionine at position 223,
  c) isoleucine at position 191,
  d) threonine, serine, or valine at position 195,
  e) methionine, threonine or guanine at position 88,
  f) histidine at position 290,
  g) glutamic acid or aspartic acid at position 221,
  h) phenylalanine, valine, or leucine at position 242,
  i) histidine at position 243,
  j) leucine, phenylalanine, or methionine at position 193,
  k) glutamine at position 256,
  l) glycine at position 213,
  m) proline, tyrosine, alanine, or serine at position 288, and
  n) glutamine at position 249; or
2) has at least 90% of the conserved amino acids of part (1).

4. A recombinant bacterial strain of claim 1 wherein the xylose isomerase has an amino acid sequence having at least 90% identity to an amino acid sequence selected from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 131, 132, 133, 134, 135, 136, 137, 138, 139, 140, 141, 142, 143, 144, 145, 146, and 147 based on the Clustal W method of alignment using the default parameters of GAP PENALTY=10, GAP LENGTH PENALTY=0.1, and Gonnet 250 series of protein weight matrix.

5. A recombinant bacterial strain of claim 1 wherein the xylose isomerase is isolated from a microorganism selected from the group consisting of *Actinoplanes, Arthrobacter, Streptomyces, Thermus, Thermobaculum, Herpetosiphon, Acidobacteria, Roseiflexus, Meiothermus, Deinococcus, Meiothermus, Stackebrandtia, Kribbella, Xylanimonas, Nocardiopsis, Catenulispora, Streptosporangium, Geodermatophilus, Actinosynnema, Saccharomonospora, Acidothermus, Tthermobifida, Nocardiodes, Janibacter, Mycobacterium, Leifsonia, Clavibacter, Micromonospora, Salinispora, Cellulomonas, Jonesia, Nakamurella, Actinomyces, Mobiluncus, Brachybacterium, Beutengergai, Frankia*, and *Actinobacterium*.

6. A recombinant bacterial strain of claim 5 wherein the xylose isomerase is isolated from *Actinoplanes missouriensis*.

7. A recombinant bacterial strain of claim 4 wherein the Group I polypeptide having xylose isomerase activity has at least 90% identity to an amino acid sequence selected from the group consisting of SEQ ID NOs:24, 66, 134, 140, 143, 145, and 147, based on the Clustal W method of alignment using the default parameters of GAP PENALTY=10, GAP LENGTH PENALTY=0.1, and Gonnet 250 series of protein weight matrix.

8. A method for the production of ethanol comprising:
 a) providing the recombinant bacterial strain of claim 1; and
 b) contacting the strain of (a) with xylose under conditions whereby the strain produces ethanol.

9. A method according to claim 8 wherein the polypeptide having xylose isomerase activity gives an E-value score of 1E-15 or less when queried using a Profile Hidden Markov Model prepared using SEQ ID NOs: 2, 24, 32, 34, 42, 54, 66, 68, 78, 96, 100, 106, 108, 122, 126, 128, 130, 132, 135, 137, and 142; the query being carried out using the hmmsearch algorithm wherein the Z parameter is set to 1 billion.

10. A method according to claim 8 wherein the polypeptide having xylose isomerase activity:
 1) has the following conserved amino acids when compared with the reference amino acid sequence of SEQ ID NO:66:
  a) leucine at position 226,
  b) methionine at position 223,
  c) isoleucine at position 191,
  d) threonine, serine, or valine at position 195,
  e) methionine, threonine or guanine at position 88,
  f) histidine at position 290,
  g) glutamic acid or aspartic acid at position 221,
  h) phenylalanine, valine, or leucine at position 242,
  i) histidine at position 243,
  j) leucine, phenylalanine, or methionine at position 193,
  k) glutamine at position 256,
  l) glycine at position 213,
  m) proline, tyrosine, alanine, or serine at position 288, and
  n) glutamine at position 249; or
 2) has at least 90% of the conserved amino acids of part (1).

11. A method according to claim 8 wherein the xylose isomerase has an amino acid sequence having at least 90% identity to an amino acid sequence selected from the group consisting of SEQ ID NOs:2, 4, 6, 8, 10, 12, 14, 16, 18, 20, 22, 24, 26, 28, 30, 2, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 131, 132, 133, 134, 135, 136, 137, 138, 139, 140, 141, 142, 143, 144, 145, 146, and 147 based on the Clustal W method of alignment using the default parameters of GAP PENALTY=10, GAP LENGTH PENALTY=0.1, and Gonnet 250 series of protein weight matrix.

12. A method according to claim 8 wherein the xylose isomerase is isolated from a microorganism selected from the group consisting of *Actinoplanes, Arthrobacter, Streptomyces, Thermus, Thermobaculum, Herpetosiphon, Acidobacteria, Roseiflexus, Meiothermus, Deinococcus, Meiothermus, Stackebrandtia, Kribbella, Xylanimonas, Nocardiopsis, Catenulispora, Streptosporangium, Geodermatophilus, Actinosynnema, Saccharomonospora, Acidothermus, Tthermobifida, Nocardiodes, janibacter, Mycobacterium, Leifsonia, Clavibacter, Micromonospora, Salinispora, Cellulomonas, jonesia, Nakamurella, Actinomyces, Mobiluncus, Brachybacterium, Beutengergai, Frankia*, and *Actinobacterium*.

\* \* \* \* \*